US008795996B2

(12) United States Patent
Wohlbach et al.

(10) Patent No.: US 8,795,996 B2
(45) Date of Patent: Aug. 5, 2014

(54) GENES RELATED TO XYLOSE FERMENTATION AND METHODS OF USING SAME FOR ENHANCED BIOFUEL PRODUCTION

(75) Inventors: Dana J. Wohlbach, Sun Prairie, WI (US); Audrey P. Gasch, Madison, WI (US)

(73) Assignee: Wisconsin Alumni Research Foundation, Madison, WI (US)

( * ) Notice: Subject to any disclaimer, the term of this patent is extended or adjusted under 35 U.S.C. 154(b) by 0 days.

(21) Appl. No.: 13/441,381

(22) Filed: Apr. 6, 2012

(65) Prior Publication Data

US 2012/0258511 A1 Oct. 11, 2012

Related U.S. Application Data

(60) Provisional application No. 61/516,650, filed on Apr. 6, 2011, provisional application No. 61/509,849, filed on Jul. 20, 2011.

(51) Int. Cl.
*C12P 7/06* (2006.01)
*C12N 15/00* (2006.01)
*C12N 1/00* (2006.01)
*C12N 9/04* (2006.01)
*C12P 7/10* (2006.01)
*C07K 14/39* (2006.01)

(52) U.S. Cl.
CPC ............... *C12P 7/06* (2013.01); *C12N 9/0006* (2013.01); *Y02E 50/17* (2013.01); *C12P 7/10* (2013.01); *C07K 14/39* (2013.01); *Y02E 50/16* (2013.01)
USPC ..................... 435/161; 435/320.1; 435/254.2; 435/254.21

(58) Field of Classification Search
None
See application file for complete search history.

(56) References Cited

U.S. PATENT DOCUMENTS

2004/0142456 A1* 7/2004 Jeffries et al. ............ 435/254.21
2007/0092957 A1* 4/2007 Donaldson et al. ........... 435/157

OTHER PUBLICATIONS

Nidetzky et al., Chemico-Biological Interactions 130-132:583-595, 2001.*
Wohlbach et al., PNAS 108:13212-13217, 2011.*
Deng, et al., Xylulokinase Activity in Various Yeasts Including *Saccharomyces cerevisiae* Containing the Cloned Xylulokinase Gene, Applied Biochemistry and Biotechnology, 1990, 24-25(1):193-199.
De Schutter, et al., Genome Sequence of the Recombinant Protein Production Host *Pichia pastoris*, Nature Biotechnology, 2009, 27(6):561-566.
Gasch, et al., Genomic Expression Programs in the Response of Yeast Cells to Environmental Changes, Molecular Biology of the Cell, 2000, 11:4241-4257.
Hur, et al., The Crystal Structure of the GCY1 Protein from *S. cerevisiae* Suggests a Divergent Aldo-Keto Reductase Catalytic Mechanism, Chemico-Biological Interactions, 2001, 130-132:527-536.
Jeffries, et al., Strain Selection, Taxonomy, and Genetics of Xylose-Fermenting Yeasts, Enzyme Microb. Technol., 1994, 16:922-932.
Jeffries, Engineering Yeasts for Xylose Metabolism, Current Opinion in Biotechnology, 2006, 17:320-326.
Jeffries, et al., Genome Sequence of the Lignocellulose-Bioconverting and Xylose-Fermenting Yeast *Pichia stipitis*, Nature Biotechnology, 2007, 25(3):319-326.
Jeppsson, et al., Reduced Oxidative Pentose Phosphate Pathway Flux in Recombinant Xylose-Utilizing *Saccharomyces cerevisiae* Strains Improves the Ethanol Yield from Xylose, Applied and Environmental Microbiology, 2002, 68(4):1604-1609.
Kellis, et al., Sequencing and Comparison of Yeast Species to Identify Genes and Regulatory Elements, Nature, 2003, 423:241-254.
Kotter, et al., Xylose Fermentation by *Saccharomyces cerevisiae*, Applied Microbiology and Biotechnology, 1993, 38(6):776-783.
Medina, et al., Elimination of Glycerol Production in Anaerobic Cultures of a *Saccharomyces cerevisiae* Strain Engineered to Use Acetic Acid as an Electron Acceptor, Applied and Environmental Microbiology, 2010, 76(1):190-195.
Nguyen, et al., Morphological and Ecological Similarities: Wood-Boring Beetles Associated with Novel Xylose-Fermenting Yeasts, *Spathaspora passalidarum* Gen. Sp. Nov. and *Candida jeffriesii* Sp. Nov., Mycological Research, 2006, 110(10):1232-1241.
Norbeck, et al., Metabolic and Regulatory Changes Associated with Growth of *Saccharomyces cerevisiae* in 1.4 M NaCl, Journal of Biological Chemistry, 1997, 272(9):5544-5554.
Otero, et al., Whole Genome Sequencing of *Saccharomyces cerevisiae*: From Genotype to Phenotype for Improved Metabolic Engineering Applications, BMC Genomics, 2010, 11:723, 17 pages.
Rizzi, et al., Xylose Fermentation by Yeasts, Applied Microbiology and Biotechnology, 1988, 29(2-3):148-154.
Rizzi, et al., Purification and Properties of the NAD+-Xylitol-Dehydrogenase from the Yeast *Pichia stipitis*, Journal of Fermentation and Bioengineering, 1989, 67(1):20-24.
Sanli, et al. Structural Biology of the Aldo-Keto Reductase Family of Enzymes—Catalysis and Cofactor Binding, Cell Biochemistry and Biophysics, 2003, 38(1):79-101.
Sonderegger, et al., Molecular Basis for Anaerobic Growth of *Saccharomyces cerevisiae* on Xylose, Investigated by Global Gene Expression and Metabolic Flux Analysis, Applied and Environmental Microbiology, 2004, 70 (4):2307-2317.

(Continued)

*Primary Examiner* — David J Steadman
(74) *Attorney, Agent, or Firm* — Quarles & Brady LLP

(57) ABSTRACT

The present invention provides isolated gene sequences involved in xylose fermentation and related recombinant yeast which are useful in methods of enhanced biofuel production, particularly ethanol production. Methods of bioengineering recombinant yeast useful for biofuel production are also provided.

12 Claims, 21 Drawing Sheets
(19 of 21 Drawing Sheet(s) Filed in Color)

(56) References Cited

OTHER PUBLICATIONS

Suh, et al., Wood Ingestion by Passalid Beetles in the Presence of Xylose-Fermenting Gut Yeasts, Molecular Ecology, 2003, 12:3137-3145.

Suh, et al., The Beetle Gut: A Hyperdiverse Source of Novel Yeasts, Mycol. Res., 2005, 109(Pt 3):261-265.

Tantirungkij, et al. Construction of Xylose-Assimilating *Saccharomyces cerevisiae*, Journal of Fermentation and Bioengineering, 1993, 75(2):83-88.

Van Vleet, et al., Yeast Metabolic Engineering for Hemicellulosic Ethanol Production, Current Opinion in Biotechnology, 2009, 20:300-306.

Wang, et al., Glycerol Production by Microbial Fermentation: A Review, Biotechnology Advances, 2001, 19:201-223.

Wenger, et al., Bulk Segregant Analysis by High-Throughput Sequencing Reveals a Novel Xylose Utilization Gene from *Saccharomyces cerevisiae*, PLoS Genetics, 2010, 6(5):e1000942, 17 pages.

Wisselink, et al., Novel Evolutionary Engineering Approach for Accelerated Utilization of Glucose, Xylose, and Arabinose Mixtures by Engineered *Saccharomyces cerevisiae* Strains, Applied and Environmental Microbiology, 2009, 75(4):907-914.

\* cited by examiner

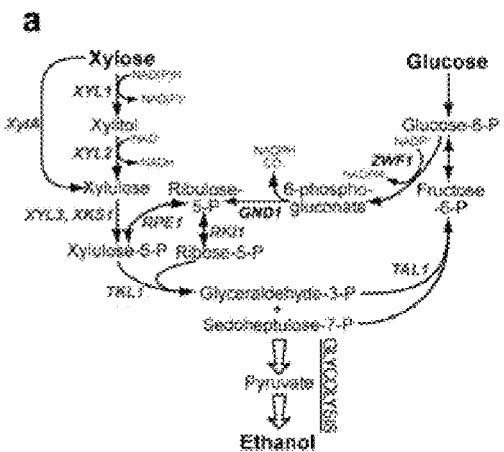
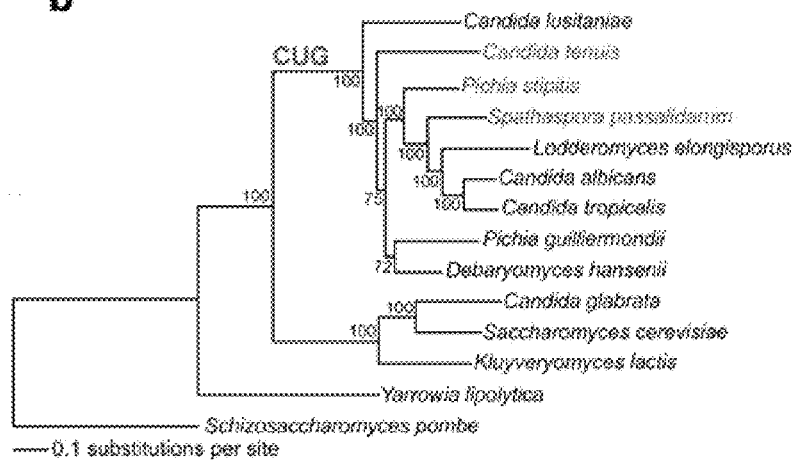
FIG. 2A-B

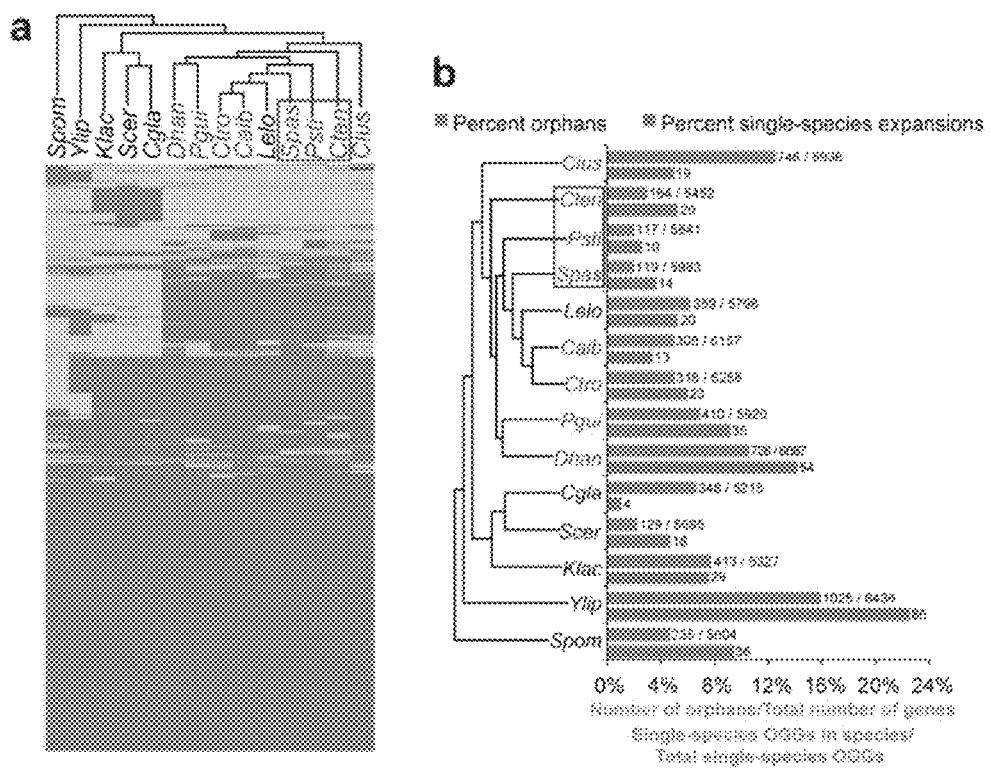
FIG. 5A-B

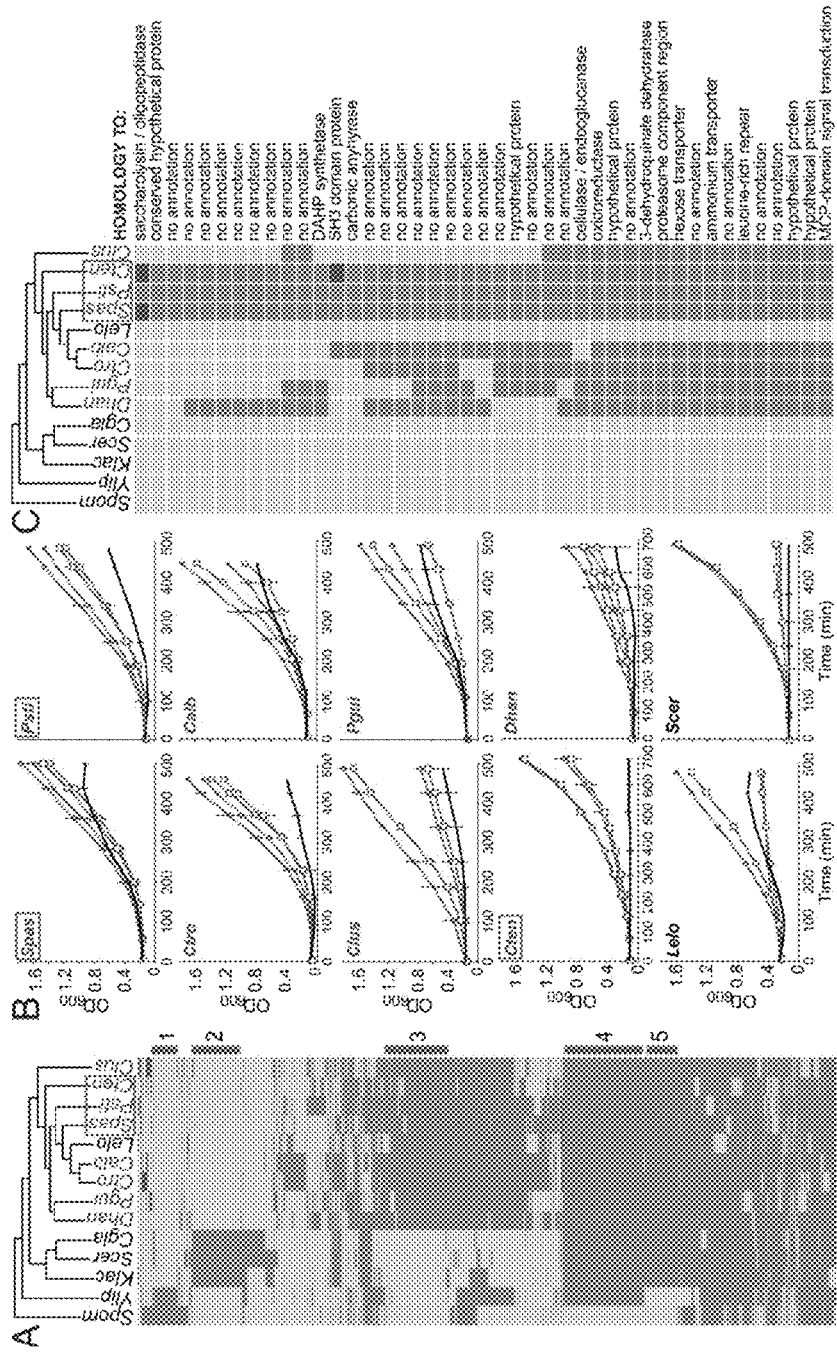
FIG. 6A-C

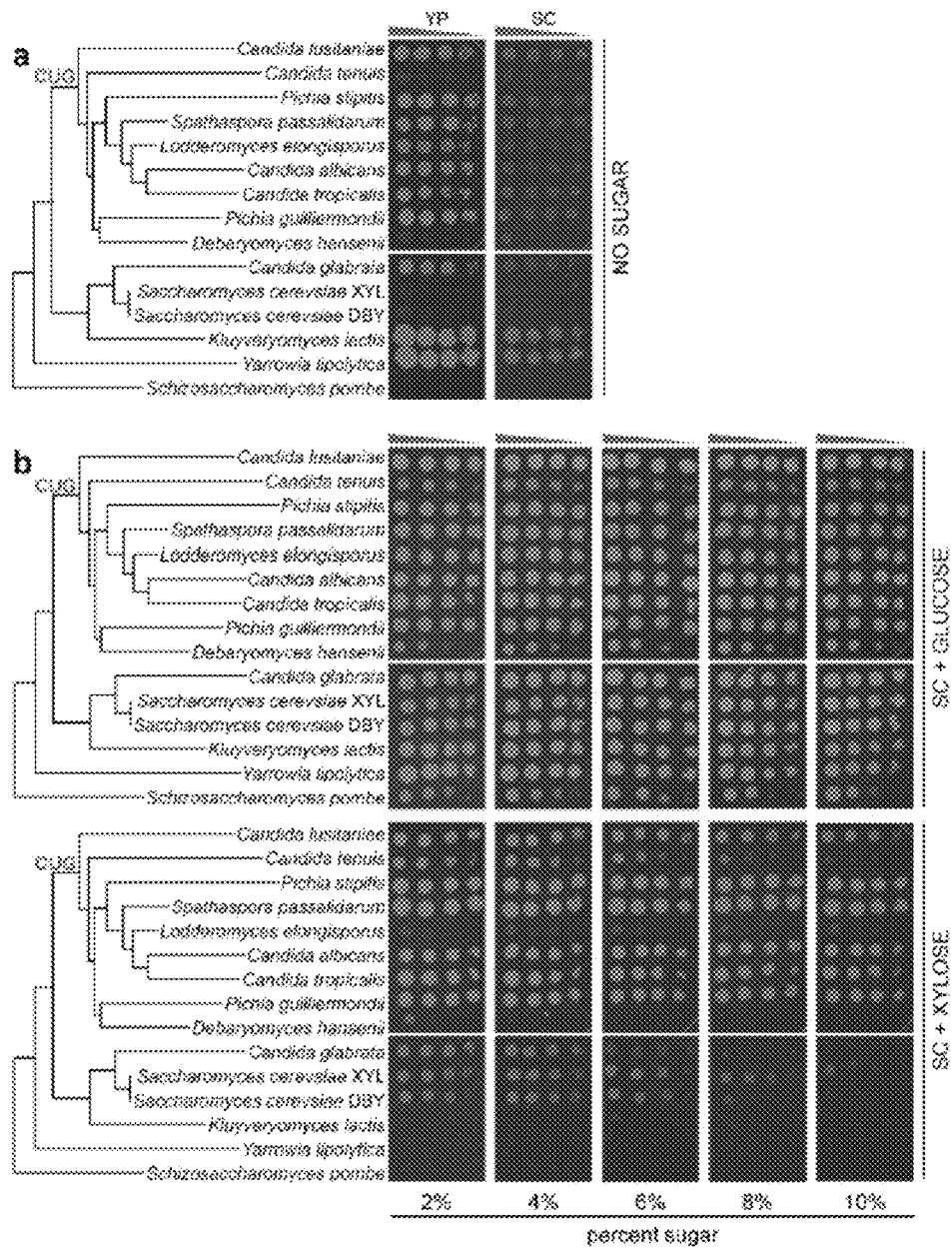
FIG. 7A-B

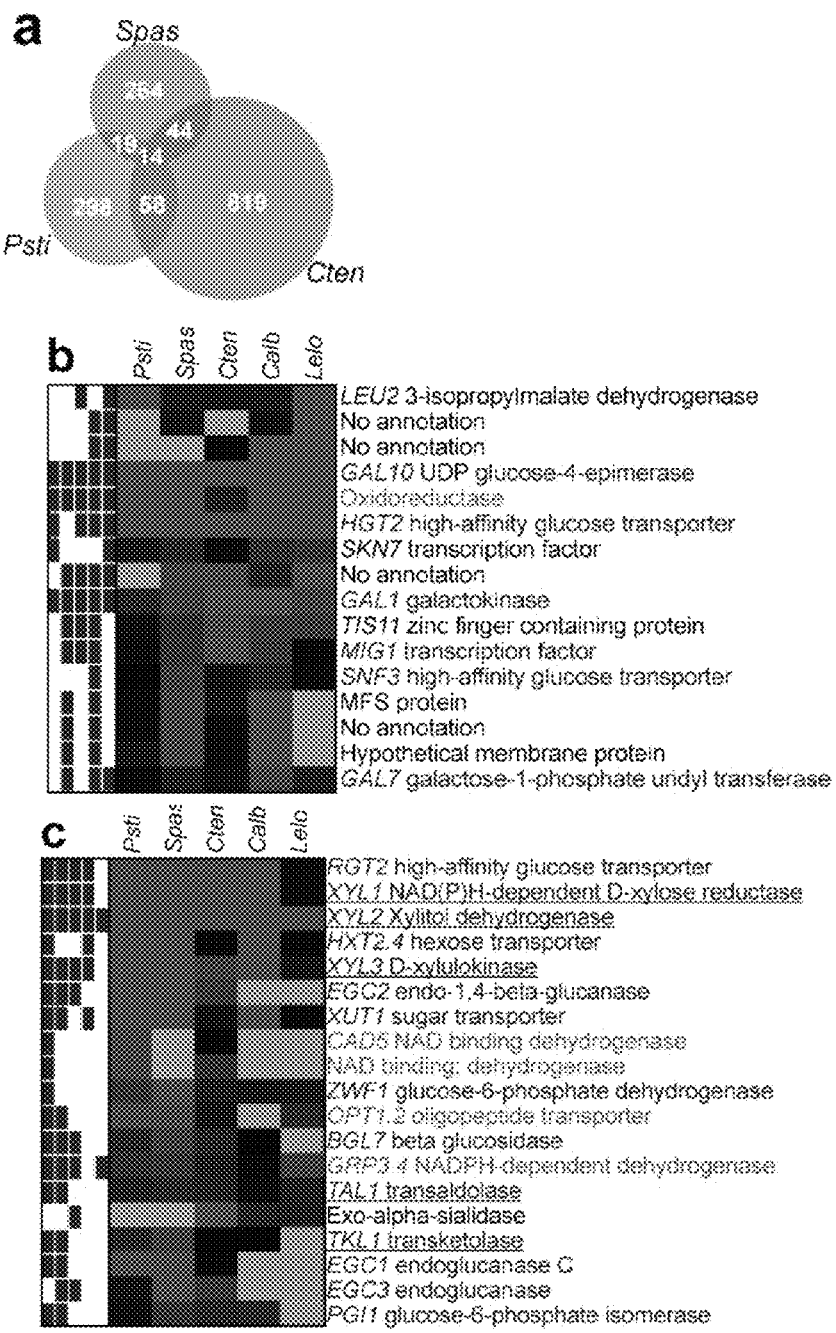
FIG. 10A-C

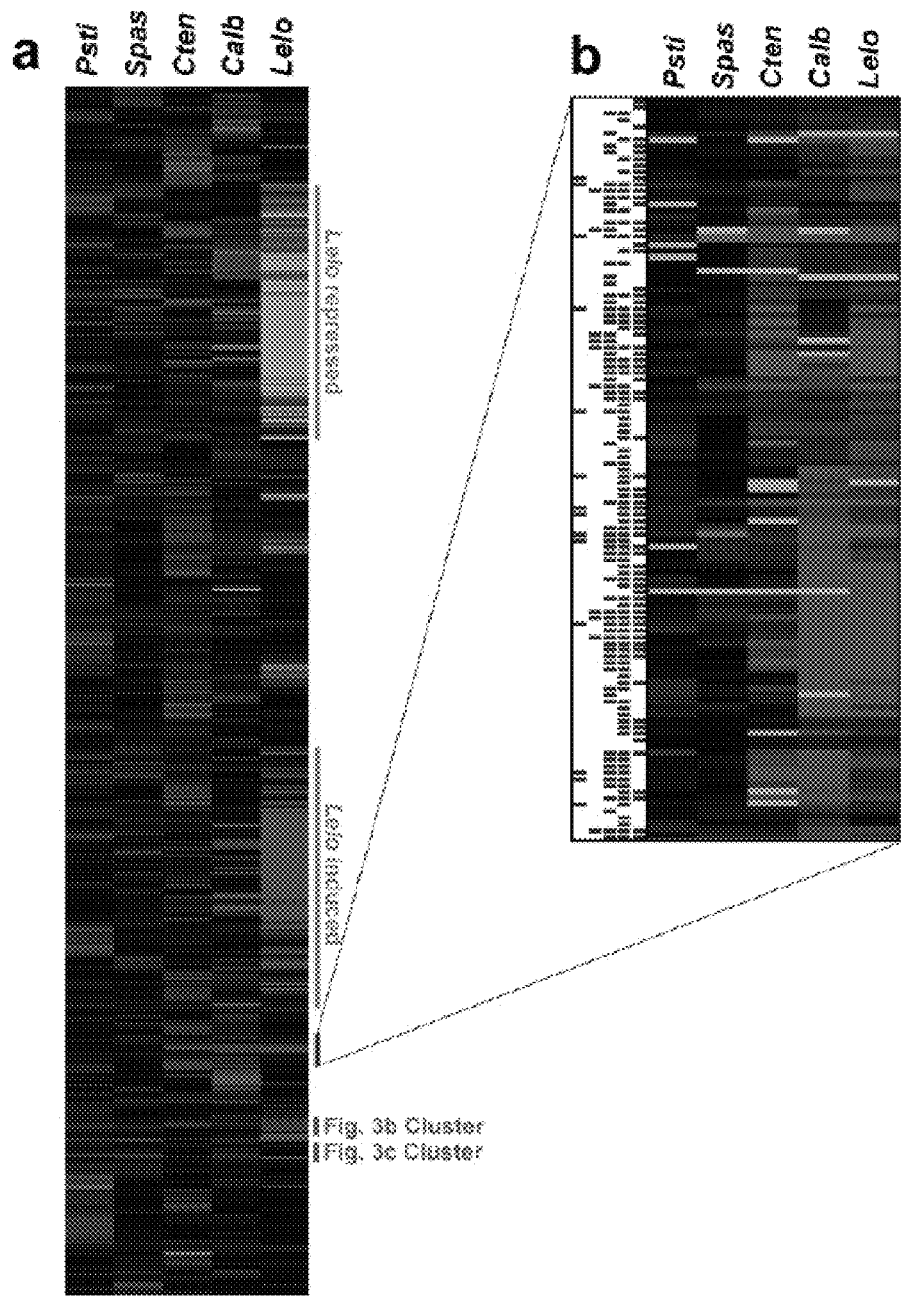
FIG. 11A-B

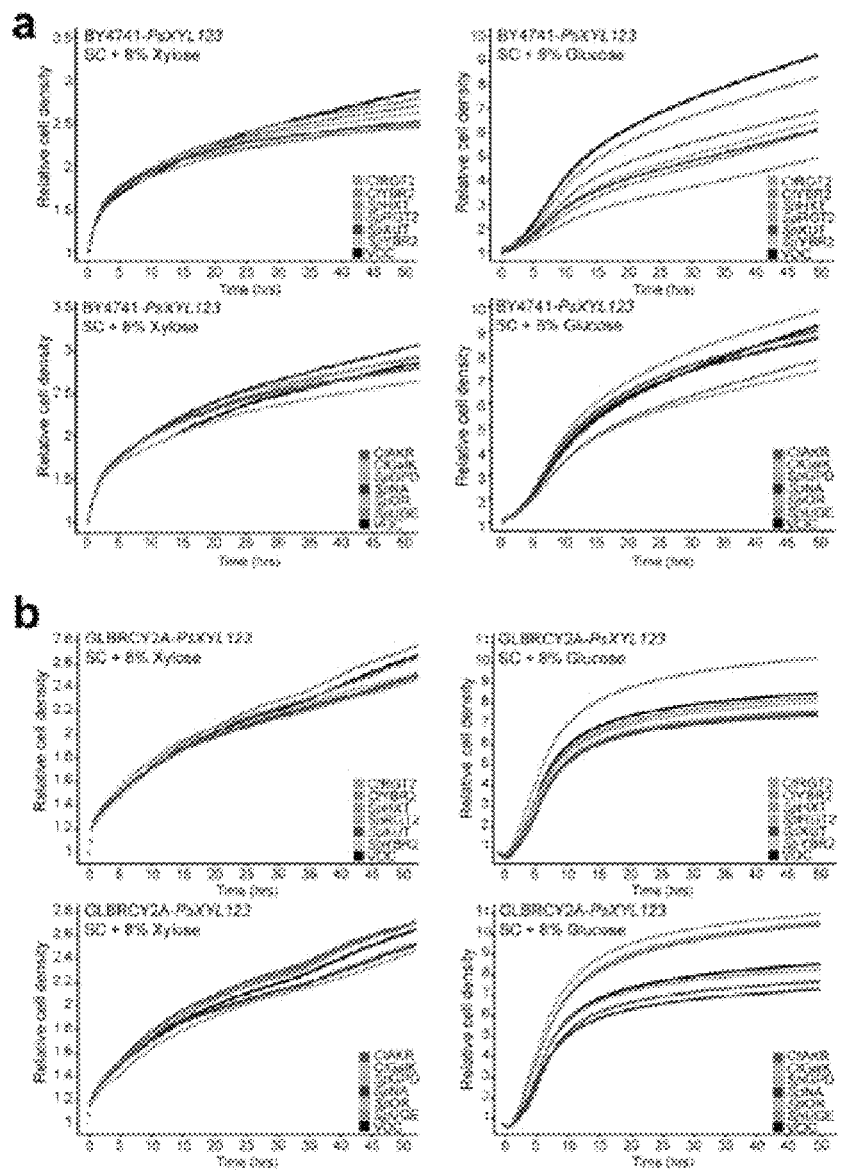
FIG. 12A-B

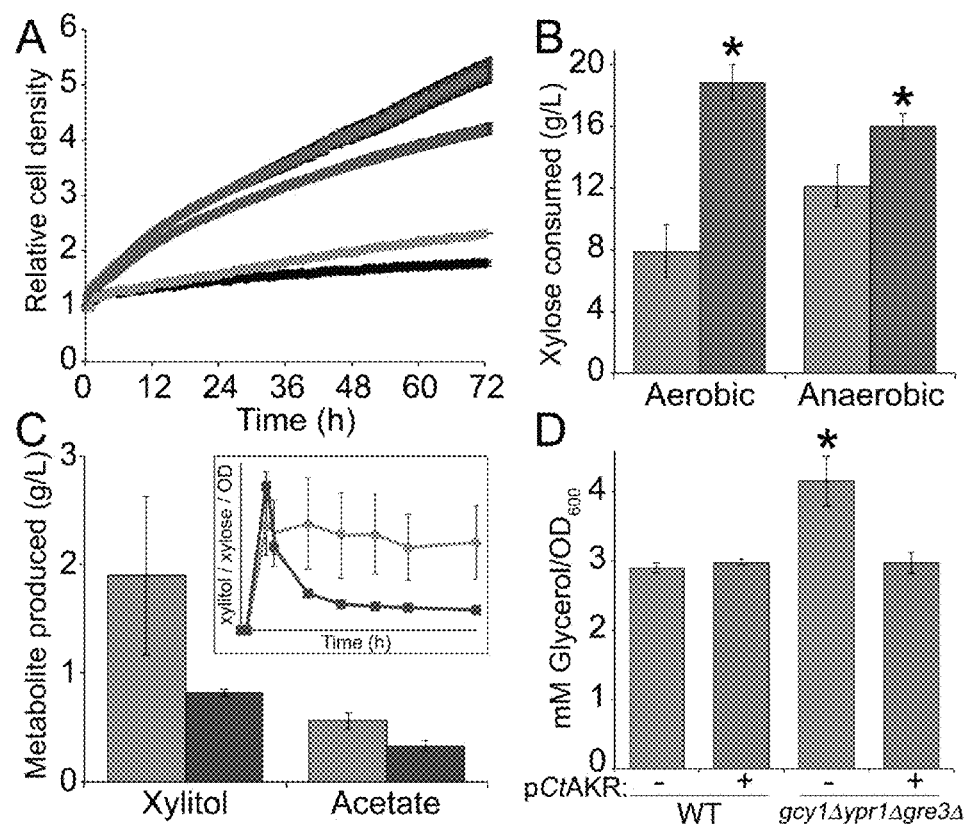
FIG. 13A-D

GENES RELATED TO XYLOSE FERMENTATION AND METHODS OF USING SAME FOR ENHANCED BIOFUEL PRODUCTION

CROSS-REFERENCE TO RELATED APPLICATION

This application claims the benefit of U.S. Provisional Patent Application No. 61/516,650, filed Apr. 6, 2011; and U.S. Provisional Patent Application No. 61/509,849, filed Jul. 20, 2011, each of which is incorporated herein by reference as if set forth in its entirety.

STATEMENT AS TO RIGHTS TO INVENTIONS MADE UNDER FEDERALLY SPONSORED RESEARCH AND DEVELOPMENT

This invention was made with government support under DE-FC02-07ER64494 awarded by the US Department of Energy. The government has certain rights in the invention.

FIELD OF THE INVENTION

The present invention relates to the production of biofuel. More particularly, the present invention relates to genes involved in xylose fermentation and methods of using same for enhanced biofuel production.

BACKGROUND OF THE INVENTION

Cellulosic biomass is an abundant substrate for biofuel production. However, many microbes cannot natively metabolize pentose sugars abundant within hemicellulose. Although engineered *Saccharomyces cerevisiae* can utilize the pentose xylose, the fermentative capacity pales in comparison to glucose, limiting the economic feasibility of industrial fermentations.

At present, only a handful of Hemiascomycete yeasts are known to naturally ferment pentose sugars, such as xylose, that are abundant in hemicellulose. Although some aspects of xylose utilization have been uncovered in xylose-fermenting fungi, much of the mechanism remains unresolved. Xylose-fermenting fungi, including the well-known *Pichia stipitis* (Psti), are associated with wood-boring passalid beetles that may rely on fungal symbionts to release nutrients from wood. Other related yeasts do not natively ferment xylose, suggesting that xylose fermentation in these yeasts has evolved in a specific and unique fungal environment.

In view of the current state of the biofuel industry, particularly ethanol production based on xylose-containing feedstocks, it can be appreciated that identifying genes related to enhanced biofuel production is a substantial challenge in the field. Accordingly, a need exists in the field to identify additional genes that influence biofuel production in yeast, and consequently engineer recombinant strains of yeast capable of increased biofuel yields from commonly-available feedstocks, including xylose-containing feedstocks.

SUMMARY OF THE INVENTION

The present invention is largely related the inventors' research efforts to better understand xylose utilization for microbial engineering. With this goal in mind, the inventors sequenced the genomes of two xylose-fermenting, beetle-associated fungi—*Spathaspora passalidarum* and *Candida tenuis*. To identify genes involved in xylose metabolism, the inventors applied a comparative genomic approach across fourteen Ascomycete genomes, mapping phenotypes and genotypes onto the fungal phylogeny, and measured genomic expression across five Hemiascomycete species with different xylose consumption phenotypes. This approach implicated a variety of apparently novel genes and processes in xylose assimilation. Several of these genes significantly improved xylose growth and utilization when engineered in *S. cerevisiae*, as described herein.

Based on the inventors' substantial efforts, the present invention provides, in a first aspect, an isolated nucleic acid having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in yeast of the isolated nucleic acid provides increased xylose fermentation in the yeast relative to a control yeast lacking over-expression of the isolated nucleic acid.

In certain embodiments, the isolated nucleic acid is contained in a recombinant vector. Certain recombinant vectors include a heterologous promoter operably linked to the isolated nucleic acid, preferably an inducible type heterologous promoter.

In another aspect, the invention is directed to a recombinant yeast engineered to contain one or more of the isolated nucleic acids having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid.

The recombinant yeast is preferably of the genus *Saccharomyces*, more preferably of the species *Saccharomyces cerevisiae*. In certain embodiments, particularly in *S. cerevisiae*, the recombinant yeast has been engineered to contain the XYL1, XYL2 and XYL3 genes, preferably from *Pichia stipitis*.

In certain embodiments of the recombinant yeast, the isolated nucleic acid is a portion of an extrachromosomal vector stably maintained in the recombinant yeast. Alternatively, the isolated nucleic acid is integrated into a chromosome of the recombinant yeast.

In yet another aspect, the invention encompasses a yeast inoculum, formulated to contain: (a) a recombinant yeast as described and claimed herein; and (b) a culture medium.

The invention further provides a method for producing ethanol by fermentation of xylose in yeast. Such a method includes steps of: (a) culturing under ethanol-producing conditions a recombinant yeast engineered to contain one or more of the isolated nucleic acids having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid; and isolating ethanol produced by the recombinant yeast.

For such methods of biofuel production, the recombinant yeast is preferably of the genus *Saccharomyces*, more preferably of the species *Saccharomyces cerevisiae*. In certain embodiments, particularly in *S. cerevisiae*, the recombinant yeast has been engineered to contain the XYL1, XYL2 and XYL3 genes, preferably from *Pichia stipitis*.

In another aspect, the invention facilitates production of a recombinant yeast useful in biofuel production. Such a method includes steps of introducing into an isolated yeast an isolated nucleic acid having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid.

For such bioengineering methods, the recombinant yeast is preferably of the genus *Saccharomyces*, more preferably of the species *Saccharomyces cerevisiae*. In certain embodiments, particularly in *S. cerevisiae*, the recombinant yeast has been further engineered to contain the XYL1, XYL2 and XYL3 genes, preferably from *Pichia stipitis*.

In yet another aspect, the invention provides a method for producing ethanol by fermentation of xylose in yeast, including steps of (a) culturing under ethanol-producing conditions a recombinant yeast comprising an isolated nucleic acid encoding an aldo/keto reductase (AKR) or a nucleotide sequence which hybridizes under stringent conditions to the isolated nucleic acid encoding AKR, or to a fully complementary nucleotide sequence thereof, and (b) isolating ethanol produced by the recombinant yeast.

In certain methods, the recombinant yeast is *Saccharomyces cerevisiae*. The recombinant yeast preferably comprises the XYL1, XYL2, and XYL3 genes, and the isolated nucleic acid is operably linked to a heterologous promoter. Suitable aldo/keto reductases for use in the present method include, but are not limited to, aldo/keto reductases isolated from *Candida tenuis*, *Pichia stipitis*, *Spathaspora passalidarum*, or *Saccharouyces cerevisiae*.

As can be appreciated, the present invention contemplates the use of recombinant yeast as described and claimed herein in the production of biofuel, including certain exemplary recombinant *S. cerevisiae* strains specifically identified in this disclosure.

This invention provides the advantage over prior biofuel-producing technologies in that embodiments of the invention utilize or are based on a robust recombinant DNA approach that provides yeast strains with appreciably increased xylose fermentation capabilities. Other objects, features and advantages of the present invention will become apparent after review of the specification, claims and drawings. The detailed description and examples enhance the understanding of the invention, but are not intended to limit the scope of the appended claims.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 2A-C provide an overview of xylose assimilation and phylogeny of xylose-fermenting fungi. (A) The simplified pathway includes genes engineered in *Saccharomyces cerevisiae* (Scer) via over-expression (red text) for improved xylose fermentation. GND1,6-phosphogluconate dehydrogenase; RKI1, ribose-5-phosphate ketol-isomerase; RPE1, ribulose-5-phosphate 3-epimerase; TAL1, transaldolase; TKL1, transketolase; XKS1/XYL3, xylulokinase; XYL1, xylose reductase; XYL2, xylitol dehydrogenase; XylA, xylose isomerase; ZWF1, glucose-6-phosphate dehydrogenase. (B) Maximum likelihood phylogeny from concatenated alignment of 136 universal orthologs, with bootstrap values. (C) Electron microscopy images of *Candida tenuis* (Cten) (top panel), *Pichia stipitis* (Psti) (middle panel), and *Spathaspora passalidarum* (Spas) (bottom panel). Scale bar, 2 µm.

FIG. 5A-B illustrate ortholog assignment across fourteen Ascomycete yeasts. (A) Patterns of ortholog presence (orange) or absence (grey) for all 5,749 multi-species OGGs, as revealed by hierarchical clustering of OGGs. Blue indicates BLAST homology despite no ortholog call. (B) Patterns of single-species OGGs. For orphan genes (blue), the total number of orphans is given along with the total number of genes in the genome and for each species, the bar represents the number of orphans in that species/the total number of genes in the genome within that species. For expansions (red), the total number of single-species OGGs is given and for each species, the bar represents the number of single species expansions in that species/the total number of single-species OGGs in the entire dataset. Green text, xylose-growing species; purple box, xylose-fermenting species.

FIG. 6A-C show mapping of phenotype and genotype onto phylogeny. (A) Hierarchical clustering based on ortholog presence (orange) or absence (grey) for 3,073 non-ubiquitous multi-species OGGs. Blue indicates BLAST homology despite no ortholog call. Functional enrichment in indicated clusters is described in Table 6. (B) Average±SD (n=3) xylose (blue) and glucose (red) growth curves for fungi growing on 2% (closed circles), 8% (open squares), or 0% (black) sugar. (C) OGG patterns for 43 genes present (orange) in xylose-fermenting species and absent (grey) in non-xylose-assimilating species, as described in text. Species abbreviations as in Table 1. Green text, xylose-growing species; purple box, xylose-fermenting species.

FIG. 7A-B illustrate xylose growth phenotypes of fourteen Ascomycetes. Cultures were initially grown in liquid YPD (1% yeast extract, 2% peptone, 2% glucose). Cultures were washed once and spotted onto plates containing 2%, 4%, 6%, 8%, or 10% glucose or xylose in minimal media. Growth was scored after three days at 30° C. Serial dilutions of cultures are indicated by grey triangles. Scer XYL, engineered strain with PsXYL123; Scer DBY, unengineered strain; YP, Yeast extract Peptone; SC, Synthetic Complete. (A) Controls grown on media containing no sugar. (B) Different concentrations of xylose or glucose in minimal media.

FIG. 10A-C depict transcriptome analysis of xylose growing cultures. (A) Overlap between significantly differentially expressed genes within the xylose-fermenters. (B) Cluster of OGGs induced in xylose in all species. (C) Cluster of OGGs with less expression on xylose in *Lodderomyces elongisporus* (Lelo). Purple blocks indicate statistically significant fold-change as measured by t-test (FDR=0.05), in the following order: Psti, Spas, Cten, *Candida albicans* (Calb), Lelo. Red, higher expression in xylose; green, lower expression on xylose; grey, no ortholog; blue text, genes related to carbohydrate metabolism; pink text, genes related to redox balance; underlined text, known targets for engineering of improved xylose utilization.

FIG. 11A-B illustrate transcriptome analysis of xylose growing cultures. Three xylose-fermenting species (Psti, Spas, Cten), one xylose-growing, non-fermenting species (Calb) and one non-xylose growing species (Lelo) were grown for three generations in 2% xylose or 2% glucose. Three biological replicate samples were measured and hierarchically clustered. The averaged log 2 fold change of xylose versus glucose is shown for all OGGs present in three or more species. Red shaded boxes, higher expression in xylose; green shaded boxes, lower expression on xylose. (A) Hierarchical clustering of all 6777 rows of expression data. Five relevant clusters are indicated. For Lelo induced/repressed clusters, see Table 9. (B) Zoom-in of cluster of genes commonly induced in Cten, Calb, and Lelo. Purple blocks indicate statistically significant measurement (t-test, FDR=0.05) in the following order: Psti, Spas, Cten, Calb, Lelo. See also Table 10.

FIG. 12A-C illustrate screening of candidate genes in engineered Scer grown in medium containing 8% xylose or 8% glucose. BY4741-PsXYL123 (A) or GLBRCY2A-PsXYL123 (B) strains transformed with multi-copy plasmids expressing the indicated genes were grown in the indicated media, and cell densities were measured every 5-10 minutes for 50 hours. Data represent the mean of four biological replicates. (C) GLBRCY2A-PsXYL123 cells over-expressing the indicated genes were spotted onto synthetic complete (SC) solid media with the indicated concentrations of xylose. Images were taken after 3 d growth at 30° C. VOC, vector only control.

FIG. 13 A-D show that CtAKR improves Scer xylose utilization. (A) Average±SD (n=4) growth on 8% xylose of Scer strain GLBRCY0A carrying PsXYL123+pCtAKR (blue), PsXYL123+VOC (vector only control; green), pCtAKR only (grey), or VOC only (black). (B) Average±SD (n=3) xylose consumed after 72 hours growth for GLBRCY0A carrying PsXYL123+pCtAKR (purple) or PsXYL123+VOC (grey). Asterisks indicate statistically significant measurements (p<0.05, t-test). (C) Average±SD (n=3) xylitol or acetate produced after 72 h anaerobic fermentation for GLBRCY0A carrying PsXYL123+pCtAKR (blue) or PsXYL123+VOC (grey). Inset: time course of average±SD (n=3) anaerobic xylitol production relative to xylose consumed. (D) Average±SD (n=3) glycerol produced in wild-type (WT, BY4741) or mutant strains carrying pCtAKR (aqua) or VOC (grey).

DETAILED DESCRIPTION OF THE INVENTION

I. In General

Figure 1:
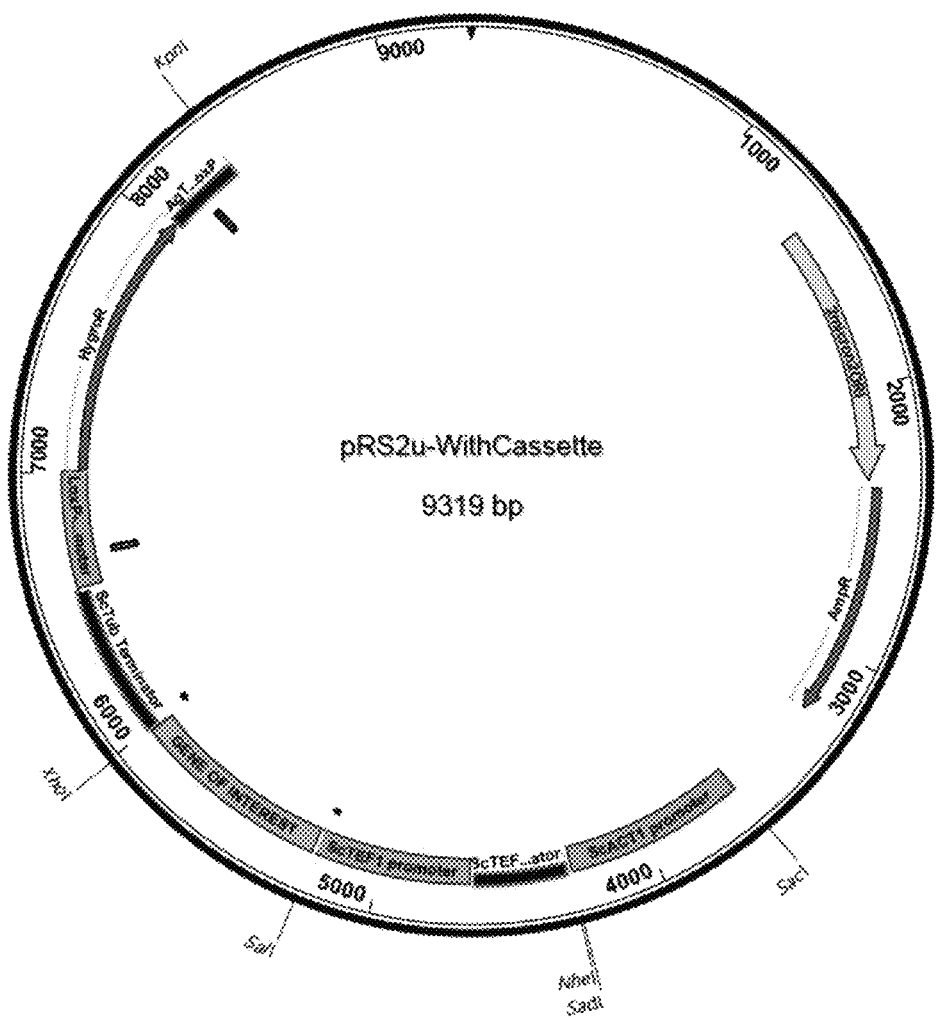
FIG. 1 illustrates a recombinant expression vector used to over-express the present genes of interest in yeast host cells.

Before the present materials and methods are described, it is understood that this invention is not limited to the particular methodology, protocols, materials, and reagents described, as these may vary. It is also to be understood that the terminology used herein is for the purpose of describing particular embodiments only, and is not intended to limit the scope of the present invention, which will be limited only by the appended claims.

It must be noted that as used herein and in the appended claims, the singular forms "a", "an", and "the" include plural reference unless the context clearly dictates otherwise. As well, the terms "a" (or "an"), "one or more" and "at least one" can be used interchangeably herein. It is also to be noted that the terms "comprising", "including", and "having" can be used interchangeably.

Unless defined otherwise, all technical and scientific terms used herein have the same meanings as commonly understood by one of ordinary skill in the art to which this invention belongs. Although any methods and materials similar or equivalent to those described herein can be used in the practice or testing of the present invention, the preferred methods and materials are now described. All publications and patents specifically mentioned herein are incorporated by reference for all purposes including describing and disclosing the chemicals, cell lines, vectors, animals, instruments, statistical analysis and methodologies which are reported in the publications which might be used in connection with the invention. All references cited in this specification are to be taken as indicative of the level of skill in the art. Nothing herein is to be construed as an admission that the invention is not entitled to antedate such disclosure by virtue of prior invention.

The practice of the present invention will employ, unless otherwise indicated, conventional techniques of molecular biology, microbiology, recombinant DNA, and immunology, which are within the skill of the art. Such techniques are explained fully in the literature. See, for example, Molecular Cloning A Laboratory Manual, 2nd Ed., ed. by Sambrook, Fritsch and Maniatis (Cold Spring Harbor Laboratory Press: 1989); DNA Cloning, Volumes I and II (D. N. Glover ed., 1985); Oligonucleotide Synthesis (M. J. Gait ed., 1984); Mullis et al. U.S. Pat. No. 4,683,195; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); and Handbook Of Experimental Immunology, Volumes I-IV (D. M. Weir and C. C. Blackwell, eds., 1986).

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters that cause a gene to be expressed in most cell types at most times are commonly referred to as "constitutive promoters". Promoters that allow the selective expression of a gene in most cell types are referred to as "inducible promoters".

A "host cell" is a cell which has been transformed or transfected, or is capable of transformation or transfection by an exogenous polynucleotide sequence. A host cell that has been transformed or transfected may be more specifically referred to as a "recombinant host cell". Preferred host cells for use in methods of the invention include yeast cells, particularly yeast cells of the genus *Saccharomyces*, more preferably of the species *Saccharomyces cerevisiae*.

The nucleic acid sequence for the CtAKR gene is recited in SEQ ID NO: 1. The nucleic acid sequence for the SpNA gene is recited in SEQ ID NO: 2. The nucleic acid sequence for the SpXUT1 gene is recited in SEQ ID NO: 3.

A polypeptide "substantially identical" to a comparative polypeptide varies from the comparative polypeptide, but has at least 80%, preferably at least 85%, more preferably at least 90%, and yet more preferably at least 95% sequence identity at the amino acid level over the complete amino acid sequence, and, in addition, it possesses the ability to increase xylose fermentation capabilities of a host yeast cell in which is has been engineered and over-expressed.

The term "substantial sequence homology" refers to DNA or RNA sequences that have de minimus sequence variations from, and retain substantially the same biological functions as the corresponding sequences to which comparison is made. In the present invention, it is intended that sequences having substantial sequence homology to the nucleic acids of SEQ ID NO:1, 2 or 3 are identified by: (1) their encoded gene product possessing the ability to increase xylose fermentation capabilities of a host yeast cell in which they have been engineered and over-expressed; and (2) their ability to hybridize to the sequence of SEQ ID NO: 1, 2 or 3, respectively, under stringent conditions.

As used herein, "hybridizes under stringent conditions" is intended to describe conditions for hybridization and washing under which nucleotide sequences that are significantly identical or homologous to each other remain hybridized to each other. Such stringent conditions are known to those skilled in the art and can be found in Current Protocols in Molecular Biology, Ausubel et al., eds., John Wiley & Sons, Inc. (1995), sections 2, 4 and 6. Additional stringent conditions can be found in Molecular Cloning: A Laboratory Manual, Sambrook et al., Cold Spring Harbor Press, Cold Spring Harbor, N.Y. (1989), chapters 7, 9 and 11. A preferred, non-limiting example of stringent hybridization conditions includes hybridization in 4× sodium chlorine/sodium citrate (SSC), at about 65-70° C. (or hybridization in 4×SSC plus 50% formamide at about 42-50° C.) followed by one or more washes in 1×SSC, at about 65-70° C. A preferred, non-limiting example of highly stringent hybridization conditions includes hybridization in 1×SSC, at about 65-70° C. (or hybridization in 4×SSC plus 50% formamide at about 42-50° C.) followed by one or more washes in 0.3×SSC, at about 65-70° C. A preferred, non-limiting example of highly stringent hybridization conditions includes hybridization in 4×SSC, at about 50-60° C. (or alternatively hybridization in 6×SSC plus 50% formamide at about 40-45° C.) followed by one or more washes in 2×SSC, at about 50-60° C. Ranges intermediate to the above-recited values, e.g., at 65-70° C. or at 42-50° C. are also intended to be encompassed by the present invention. SSPE (1×SSPE is 0.15 M NaCl, 10 mM $NaH_2PO_4$, and 1.25 mM EDTA, pH 7.4) can be substituted for SSC (1×SSPE is 0.15 M NaCl and 15 mM sodium citrate) in the hybridization and wash buffers; washes are performed for 15 minutes each after hybridization is complete. The hybridization temperature for hybrids anticipated to be less than 50 base pairs in length should be 5-10° C. less than the melting temperature ($T_m$) of the hybrid, where $T_m$ is determined according to the following equations. For hybrids less than 18 base pairs in length, $T_m$ (° C.)=2(# of A+T bases)+4(# of G+C bases). For hybrids between 18 and 49 base pairs in length, $T_m$ (° C.)=81.5+16.6($\log_{10}$[Na+])+0.41(% G+C)−(600/N), where N is the number of bases in the hybrid, and [Na+] is the concentration of sodium ions in the hybridization buffer ([Na+] for 1×SSC=0.165 M). It will also be recognized by the skilled practitioner that additional reagents may be added to the hybridization and/or wash buffers to decrease non-specific hybridization of nucleic acid molecules to membranes, for example, nitrocellulose or nylon membranes, including but not limited to blocking agents (e.g., BSA or salmon or herring sperm carrier DNA), detergents (e.g., SDS), chelating agents (e.g., EDTA), Ficoll, PVP and the like. When using nylon membranes, in particular, an additional preferred, non-limiting example of stringent hybridization conditions is hybridization in 0.25-0.5M $NaH_2PO_4$, 7% SDS at about 65° C., followed by one or more washed at 0.02M $NaH_2PO_4$, 1% SDS at 65° C., see e.g., Church and Gilbert (1984) Proc. Natl. Acad. Sci. USA 81: 1991-1995, (or alternatively 0.2×SSC, 1% SDS).

"Polynucleotide(s)" generally refers to any polyribonucleotide or polydeoxyribonucleotide, which may be unmodified RNA or DNA or modified RNA or DNA. "Polynucleotide(s)" include, without limitation, single- and double-stranded DNA, DNA that is a mixture of single- and double-stranded regions or single-, double- and triple-stranded regions, single- and double-stranded RNA, and RNA that is mixture of single- and double-stranded regions, hybrid molecules comprising DNA and RNA that may be single-stranded or, more typically, double-stranded, or triple-stranded regions, or a mixture of single- and double-stranded regions. As used herein, the term "polynucleotide(s)" also includes DNAs or RNAs as described above that contain one or more modified bases. Thus, DNAs or RNAs with backbones modified for stability or for other reasons are "polynucleotide(s)" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art. The term "polynucleotide(s)" as it is employed herein embraces such chemically, enzymatically or metabolically modified forms of polynucleotides, as well as the chemical forms of DNA and RNA characteristic of viruses and cells, including, for example, simple and complex cells. "Polynucleotide(s)" also embraces short polynucleotides often referred to as oligonucleotide(s).

The term "isolated nucleic acid" used in the specification and claims means a nucleic acid isolated from its natural environment or prepared using synthetic methods such as those known to one of ordinary skill in the art. Complete purification is not required in either case. The nucleic acids of the invention can be isolated and purified from normally associated material in conventional ways such that in the purified preparation the nucleic acid is the predominant species in the preparation. At the very least, the degree of purification is such that the extraneous material in the preparation does not interfere with use of the nucleic acid of the invention in the manner disclosed herein. The nucleic acid is preferably at least about 85% pure, more preferably at least about 95% pure and most preferably at least about 99% pure.

Further, an isolated nucleic acid has a structure that is not identical to that of any naturally occurring nucleic acid or to that of any fragment of a naturally occurring genomic nucleic acid spanning more than three separate genes. An isolated nucleic acid also includes, without limitation, (a) a nucleic acid having a sequence of a naturally occurring genomic or extrachromosomal nucleic acid molecule but which is not flanked by the coding sequences that flank the sequence in its natural position; (b) a nucleic acid incorporated into a vector or into a prokaryote or eukaryote genome such that the resulting molecule is not identical to any naturally occurring vector or genomic DNA; (c) a separate molecule such as a cDNA, a genomic fragment, a fragment produced by polymerase chain reaction (PCR), or a restriction fragment; and (d) a recombinant nucleotide sequence that is part of a hybrid gene. Specifically excluded from this definition are nucleic acids present in mixtures of clones, e.g., as those occurring in a DNA library such as a cDNA or genomic DNA library. An isolated nucleic acid can be modified or unmodified DNA or RNA, whether fully or partially single-stranded or double-stranded or even triple-stranded. A nucleic acid can be chemically or enzymatically modified and can include so-called non-standard bases such as inosine, as described in a preceding definition.

The term "operably linked" means that the linkage (e.g., DNA segment) between the DNA segments so linked is such that the described effect of one of the linked segments on the other is capable of occurring. "Linked" shall refer to physically adjoined segments and, more broadly, to segments which are spatially contained relative to each other such that the described effect is capable of occurring (e.g., DNA segments may be present on two separate plasmids but contained within a cell such that the described effect is nonetheless achieved). Effecting operable linkages for the various purposes stated herein is well within the skill of those of ordinary skill in the art, particularly with the teaching of the instant specification.

As used herein the term "gene product" shall refer to the biochemical material, either RNA or protein, resulting from expression of a gene.

The term "heterologous" is used for any combination of DNA sequences that is not normally found intimately associated in nature (e.g., a green fluorescent protein (GFP) reporter gene operably linked to a SV40 promoter). A "heterologous gene" shall refer to a gene not naturally present in a host cell (e.g., a luciferase gene present in a retinoblastoma cell line).

As used herein, the term "homolog" refers to a gene related to a second gene by descent from a common ancestral DNA sequence. The term, homolog, may apply to the relationship between genes separated by the event of speciation (i.e., orthologs) or to the relationship between genes separated by the event of genetic duplication (i.e., paralogs). "Orthologs" are genes in different species that evolved from a common ancestral gene by speciation. Normally, orthologs retain the same function in the course of evolution. Identification of orthologs is important for reliable prediction of gene function in newly sequenced genomes. "Paralogs" are genes related by duplication within a genome. Orthologs retain the same function in the course of evolution, whereas paralogs evolve new functions, even if these are related to the original one.

The term "biofuel" refers to a wide range of fuels which are in some way derived from biomass. The term covers solid biomass, liquid fuels and various biogases. For example, bioethanol is an alcohol made by fermenting the sugar components of plant materials and it is produced largely from sugar and starch crops. Cellulosic biomass, such as trees and grasses, are also used as feedstocks for ethanol production and the present invention finds its primary application in this specific field. Of course, ethanol can be used as a fuel for vehicles in its pure form, but it is usually used as a gasoline additive to increase octane and improve vehicle emissions.

"Yeasts" are eukaryotic micro-organisms classified in the kingdom Fungi. Most reproduce asexually by budding, although a few undergo sexual reproduction by meiosis. Yeasts are unicellular, although some species with yeast forms may become multi-cellular through the formation of a string of connected budding cells known as pseudohyphae, or false hyphae, as seen in most molds. Yeasts do not form a single taxonomic or phylogenetic grouping. The term "yeast" is often taken as a synonym for *Saccharomyces cerevisiae*, but the phylogenetic diversity of yeasts is shown by their placement in separate phyla, principally the Ascomycota and the Basidiomycota. The budding yeasts ("true yeasts") are classified in the order Saccharomycetales.

The nucleotides that occur in the various nucleotide sequences appearing herein have their usual single-letter designations (A, G, T, C or U) used routinely in the art. In the present specification and claims, references to Greek letters may either be written out as alpha, beta, etc. or the corresponding Greek letter symbols (e.g., $\alpha$, $\beta$, etc.) may sometimes be used.

Accompanying this specification is an Appendix A which describes in further detail the inventors' method, materials and results. Appendix A is incorporated herein by reference in its entirety for all purposes.

II. The Invention

Efficient fermentation of cellulosic feedstocks is an essential step in the production of biofuel from plant materials. The six-carbon sugar glucose and the five-carbon sugar xylose are the two most abundant monomeric carbohydrates found in hemicellulose. Although *S. cerevisiae*, the yeast most commonly utilized for industrial fermentation, is able to utilize glucose, it is unable to ferment xylose. However, several Ascomycete yeasts that both ferment and assimilate xylose have been identified, including *P. stipitis*, whose genome has recently been sequenced.

To elucidate genetic features that underlie the ability to ferment xylose, the inventors have exploited the variation in natural growth and fermentation phenotypes of Ascomycete yeast. They have carried out whole-genome sequencing on two xylose-fermenting yeasts, *C. tenuis* and *Sp. passalidarum*, and performed comparative genomic analyses between the xylose-fermenting yeasts *P. stipitis, C. tenuis, Sp. passalidarum* and eleven other non-xylose-fermenting yeasts, including *S. cerevisiae*. The vast majority of the genes known to be required for xylose fermentation are present in all Ascomycete yeasts, regardless of their xylose fermentation ability. Therefore, to identify new candidates for genes involved in xylose utilization, the inventors compared patterns of gene presence/absence with xylose growth and fermentation phenotypes across the Ascomycetes. A variety of genes unique to xylose-fermenting species, which are candidate genes for xylose transport, xylose assimilation, fermentation, or other biofuel-relevant processes, were identified and the present invention is directed to three genes demonstrating substantial utility in enhancing biofuel production.

Accordingly, the present invention provides an isolated nucleic acid having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in yeast of the isolated nucleic acid provides increased xylose fermentation in the yeast relative to a control yeast lacking over-expression of the isolated nucleic acid.

The present invention will employ strong heterologous promoters, preferably inducible versions thereof. Suitable promoters for use in the invention include, e.g., the ACT1, PGK1, TDH3, TEF1, or TEF2 promoters, or promoters of other highly expressed *S. cerevisiae* genes. In preferred embodiments, the promoter is an inducible heterologous promoter and enhanced xylose fermentation in the recombinant yeast is conferred by induction of the inducible heterologous promoter. Inducible heterologous promoters suitable for use in the present invention include, e.g., the GAL4, CUP1, PHO5, or tetO7 promoter.

In another aspect, the invention is directed to a recombinant yeast engineered to contain one or more of the isolated nucleic acids having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid.

The recombinant yeast is preferably of the genus *Saccharomyces*, more preferably of the species *S. cerevisiae*. Such recombinant yeast will have at least one copy of the gene which enhances xylose fermentation, and may have two or more, usually not exceeding about 200, depending upon whether the construct is integrated into the genome, amplified, or is present on an extrachromosomal element having multiple copy numbers. Integration or non-integration may be selected, depending upon the stability required for maintenance of the extrachromosomal element, the stability of the particular extrachromosomal element prepared, the number of copies desired, the level of transcription available depending upon copy number, and the like.

As can be appreciated, the present invention contemplates the use of recombinant yeast as described herein for use in the production of biofuel, including certain exemplary recombinant *S. cerevisiae* strains specifically identified herein, including, e.g., S288c-derived strain BY4741 or wild-strain derived GLBRCY2A.

The present invention further encompasses a method of providing a recombinant yeast useful in biofuel production. Such a method includes steps of introducing into an isolated yeast an isolated nucleic acid having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid.

Nucleic acid constructs useful in the invention may be prepared in conventional ways, by isolating the desired genes from an appropriate host, by synthesizing all or a portion of the genes, or combinations thereof. Similarly, the regulatory signals, the transcriptional and translational initiation and termination regions, may be isolated from a natural source, be synthesized, or combinations thereof. The various fragments may be subjected to endonuclease digestion (restriction), ligation, sequencing, in vitro mutagenesis, primer repair, or the like. The various manipulations are well known in the literature and will be employed to achieve specific purposes.

The various nucleic acids and/or fragments thereof may be combined, cloned, isolated and sequenced in accordance with conventional ways. After each manipulation, the DNA fragment or combination of fragments may be inserted into a cloning vector, the vector transformed into a cloning host, e.g. *Escherichia coli*, the cloning host grown up, lysed, the plasmid isolated and the fragment analyzed by restriction analysis, sequencing, combinations thereof, or the like.

Various vectors may be employed during the course of development of the construct and transformation of host cells. Thee vectors may include cloning vectors, expression vectors, and vectors providing for integration into the host or the use of bare DNA for transformation and integration. The cloning vector will be characterized, for the most part, by having a replication original functional in the cloning host, a marker for selection of a host containing the cloning vector, may have one or more polylinkers, or additional sequences for insertion, selection, manipulation, ease of sequencing, excision, or the like. In addition, shuttle vectors may be employed, where the vector may have two or more origins of replication, which allows the vector to be replicated in more than one host, e.g. a prokaryotic host and a eukaryotic host.

Expression vectors will usually provide for insertion of a construct which includes the transcriptional and translational initiation region and termination region or the construct may lack one or both of the regulatory regions, which will be provided by the expression vector upon insertion of the sequence encoding the protein product. Thus, the construct may be inserted into a gene having functional transcriptional and translational regions, where the insertion is proximal to the 5'-terminus of the existing gene and the construct comes under the regulatory control of the existing regulatory regions. Normally, it would be desirable for the initiation codon to be 5' of the existing initiation codon, unless a fused product is acceptable, or the initiation codon is out of phase with the existing initiation codon. In other instances, expression vectors exist which have one or more restriction sites between the initiation and termination regulatory regions, so that the structural gene may be inserted at the restriction site(s) and be under the regulatory control of these regions. Of particular interest for the subject invention as the vector for expression, either for extrachromosomal stable maintenance or integration, are constructs and vectors, which in their stable form in the host are free of prokaryotic DNA. An exemplary recombinant expression vector is depicted in FIG. 1 and its construction, characteristics and use are described in the methods below.

For extrachromosomal stable maintenance, it may be necessary to provide for selective pressure on those hosts maintaining the construct. Stable maintenance may be achieved by providing for resistance against a cytotoxic agent, e.g. an antibiotic, such as kanamycin or G418, or by imparting prototrophy to an auxotrophic host. For stable maintenance in a yeast host, the 2 micron origin of replication may be employed or a combination of a centromere, e.g. CEN3, and ars. For integration, generally homologous integration will be desirable, so that the construct will be flanked by at least about 50 bp, more usually at least about 100 bp on each side of the construct of a sequence homologous with a sequence present in the genome of the host.

The yeast host may be transformed in accordance with conventional ways. Conveniently, yeast protoplasts may be transformed in the presence of a fusogen, such as a non-ionic detergent, e.g. polyethyleneglycol.

Yeast strains that may serve as yeast hosts include, for example, certain yeast strains useful in biofuel production such as, e.g., BY4741, YB210, CEN.PK, PE-2, BG-1, CAT-1, SA-1, VR-1 or 424A(LNH-ST) and derivatives thereof. In certain yeast strains, particularly *S. cerevisiae*, the strains have been engineered to carry the XYL1, XYL2 and XYL3 genes of *P. stipitis*, which are generally required for most *S. cerevisiae* strains to ferment xylose. Of course, alternative genes of roughly equal function may be used in certain embodiments; e.g., xylose isomerase (XI) may substitute for XYL1/2 in alternative embodiments, and yet other yeast strains may be engineered to include XYL1 and XYL2 genes of *P. stipitis* but rely on native *S. cerevisiae* XYL3. Cassettes containing one or more of XYL1, XYL2 and XYL3 are available in the field. For example, XYL nucleotide sequences from *P. stipitis* CB56054 are available at Accession numbers: XYL1: mRNA=XM_001385144, protein=XP_001385181; XYL2: mRNA=XM_001386945, protein=XP_001386982; and XYL3: mRNA=AF127802, protein=AAF72328.

In another aspect, the present invention provides a method for producing ethanol from a recombinant yeast. Such a method includes steps of: (a) culturing under ethanol-producing conditions a recombinant yeast engineered to contain one or more of the isolated nucleic acids having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid; and isolating ethanol produced by the recombinant yeast.

Particularly useful recombinant yeast for biofuel production methods are based on *S. cerevisiae*, particularly strains that have been engineered to carry the XYL1, XYL2 and XYL3 genes of *P. stipitis*, in addition one or more of the genes described and claimed herein.

In view of the various industrial uses and storage conditions the present recombinant yeasts will be subjected to, the invention further encompasses yeast inoculums which contain at least (a) a recombinant yeast recombinant yeast engineered to contain one or more of the isolated nucleic acids having: (a) the nucleotide sequence of SEQ ID NO:1, SEQ ID NO:2, or SEQ ID NO:3; or (b) a nucleotide sequence which hybridizes under stringent conditions to SEQ ID NO:1, SEQ ID NO:2, or SEQ ID NO:3, or to a fully complementary nucleotide sequence thereof, wherein over-expression in the yeast of the isolated nucleic acid provides increased xylose fermentation in the yeast relative to a control yeast lacking over-expression of the isolated nucleic acid; and (b) a culture medium.

The following experimental data are provided to illustrate the invention. It is to be understood that a person skilled in the art who is familiar with the methods may use other yeast strains, recombinant vectors, and methodology which can be equally used for the purpose of the present invention. These alterations are included in the scope of the invention.

III. Examples

In this section, the inventors describe various materials, methods and results related to and supportive of the present invention.

Example 1

Genomic Analysis of Two Xylose-Fermenting Yeasts

To better understand xylose assimilation, the inventors sequenced the genomes of two xylose-fermenting beetle-associated yeasts, Sp. *passalidarum* (Spas, NRRL Y-27907) and *Candida tenuis* (Cten, NRRL Y-1498) (FIG. 2B-C), for comparison to the existing *P. stipitis* genome (Table 2; Jeffries et al., *Nat Biotechnol* 25:319-326 (2007)). The Spas genome was sequenced to 43.77X coverage over 13.1 Mb arranged in eight scaffolds. The Cten genome was sequenced to 26.9X coverage, generating 10.7 Mb in 61 scaffolds representing eight chromosomes. To identify genes involved in xylose metabolism, a comparative genomic approach across fourteen Ascomycete genomes was used, mapping phenotypes and genotypes onto the fungal phylogeny, and measured genomic expression across five Hemiascomycete species with different xylose consumption phenotypes. Compared to other sequenced Hemiascomyetes, genome size and composition in the xylose-fermenting yeasts span the range from among the most compact (in Cten, a 10.7 Mb genome with 5533 protein-coding genes) to among the largest (the 15.4 Mb genome of Psti) (Table 1 and Table 2). Sixty-seven percent of Spas and 74% of Cten genes are orthologs located in regions syntenic with each other (FIG. 3), and about half of all genes in Spas, Cten, and Psti show three-way synteny.

Figure 4A:
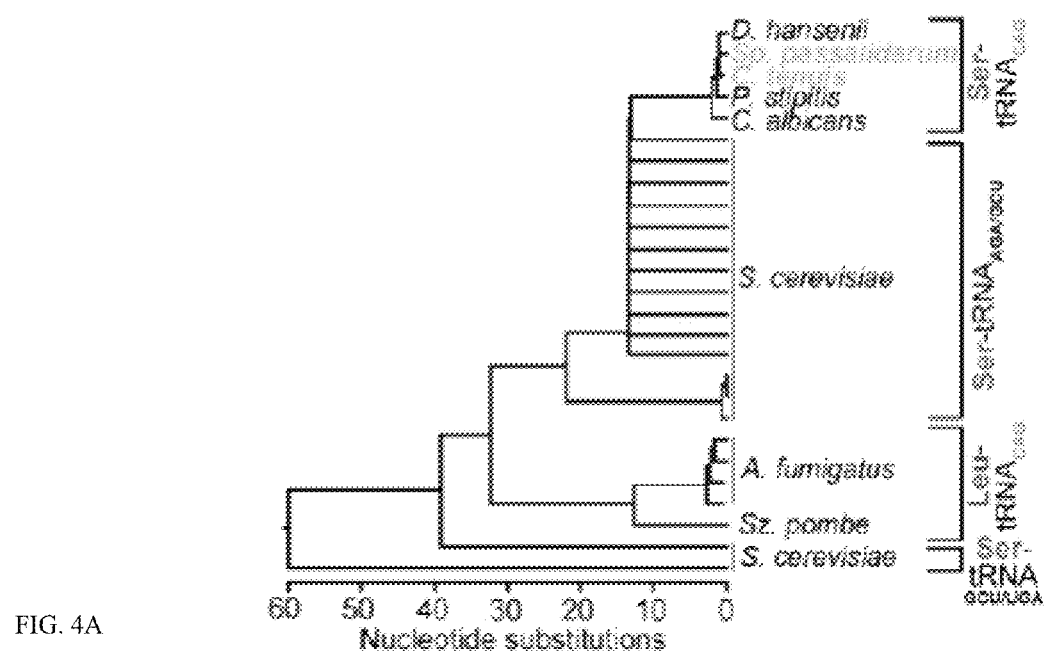
FIG. 4A-B illustrate analysis of CUG codon usage in Cten and Spas. (A) Neighbor joining tree of tRNAs created from ClustalW alignment in (A). (B) Alignment of CUG codons to orthologous Scer amino acids (AAs). For each species, the AA sequence of protein coding genes containing one or more CUG codons was aligned to the orthologous Scer protein. The location of each CUG codon was mapped to the orthologous AA position in Scer, and the fraction of CUG codons aligned to serine (red), or leucine (blue) is shown.
Figure 4B:
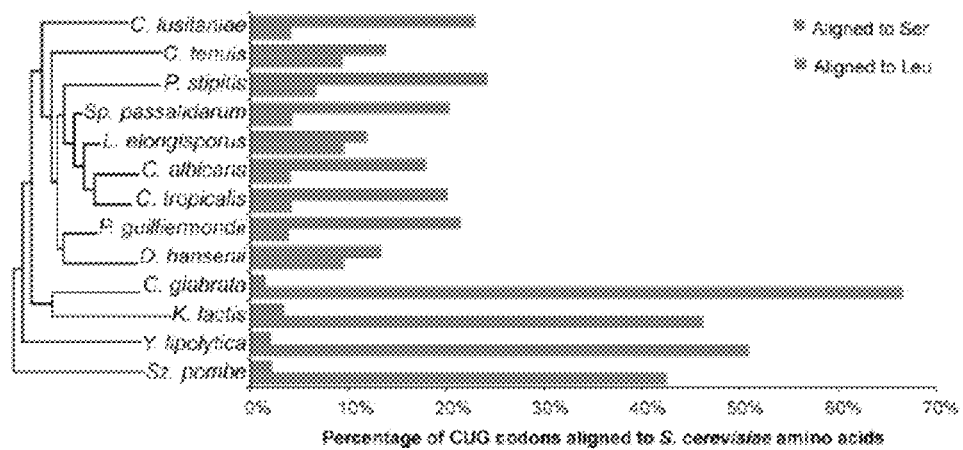

*Nucleic Acids Res* 21:4039-4045 (1993); Santos & Tuite *Nucleic Acids Res* 23:1481-1486 (1995); Sugita & Nakase *Syst Appl Microbiol* 22:79-86 (1999)). tRNA sequences across the fourteen species in the analysis were compared and the inventors confirmed that Spas and Cten harbor the serine tRNA evolved to recognize the CUG codon (Ohama et al. (1993) supra), whereas there were no identifiable sequences similar to standard Scer serine tRNAs (FIG. 4B). Likewise, a genome-wide scan revealed that the majority of CUG codons from *Candida* and related species (including Spas and Cten) are decoded as serine in Scer orthologs; CUG codons from

TABLE 1

Strain sources and genome statistics.

| | Organism | Strain | Genome Size (Mb) | % GC | Total ORFs | Sequencing Coverage | Data Source | Reference |
|---|---|---|---|---|---|---|---|---|
| CUG clade | *Sp. passalidarum* (Spas) | NRRL Y-27907 | 13.2 | 42.0 | 5983 | 44$^\perp$ | DOE JGI | Wohlbach et al. (2011) *Proc. Natl. Acad. Sci.* USA 108: 13212-13217. |
| | *C. tenuis* (Cten) | NRRL Y-1498 | 10.7 | 42.9 | 5533 | 27$^\perp$ | DOE JGI | Wohlbach et al. (2011) |
| | *P. stipitis* (Psti) | CBS 6054 | 15.4 | 42.3 | 5841 | complete | DOE JGI | Jeffries et al. (2007) |
| | *C. albicans* (Calb) | WO-1 | 14.4 | 33.5 | 6157 | 10$^\perp$ | Broad Institute | Jones et al. (2004) *Proc Natl Acad Sci* USA 101: 7329-7334. |
| | *C. tropicalis* (Ctro) | MYA-3404 | 14.6 | 33.1 | 6258 | 10$^\perp$ | Broad Institute | Butler et al. (2009) |
| | *C. lusitaniae* (Clus) | ATCC 42720 | 12.1 | 46.8 | 5936 | 9$^\perp$ | Broad Institute | Butler et al. (2009) |
| | *D. hansenii* (Dhan) | CBS767 | 12.2 | 37.5 | 6887 | 10$^\perp$ | Genolevures | Dujon et al. (2004) *Nature* 430: 35-44 |
| | *L. elongisporus* (Lelo) | NRRL YB-4239 | 15.5 | 40.4 | 5796 | 9$^\perp$ | Broad Institute | Butler et al. (2009) |
| | *P. guilliermondii* (Pgui) | ATCC 6260 | 10.6 | 44.5 | 5920 | 12$^\perp$ | Broad Institute | Butler et al. (2009) |
| | *C. glabrata* (Cgla) | CBS 138 | 12.3 | 40.5 | 5215 | 8$^\perp$ | Genolevures | Dujon et al. (2004) supra |
| | *K. lactis* (Klac) | NRRL Y-1140 | 10.7 | 40.1 | 5327 | 11$^\perp$ | Genolevures | Dujon et al. (2004) supra |
| | *S. cerevisiae* (Scer) | S288c | 12.1 | 34.4 | 5695 | complete | SGD | Goffeau et al. (1996) *Science* 274: 546, 563-547 |
| | *Y. lipolytica* (Ylip) | CLIB122 | 20.5 | 53.7 | 6436 | 10$^\perp$ | Genolevures | Dujon et al. (2004) supra |
| | *Sz. pombe* (Spom) | 972h- | 12.5 | 39.6 | 5004 | 8$^\perp$ | Wellcome Trust | Wood et al. (2002) *Nature* 415: 871-880. |

$^a$ DOE JGI, Department of Energy Joint Genome Institute SGD, *Saccharomyces* Genome Database

TABLE 2

Genome statistics for the xylose-fermenting fungi.

| Strain | Spas | Cten | Psti |
|---|---|---|---|
| | NRRL Y-27907 | NRRL Y-1498 | CBS 6054 |
| Genome size (Mb) | 13.1 | 10.6 | 15.4 |
| Number of chromosomes | 8 | 8 | 8 |
| Total scaffolds | 8 | 61 | 9 |
| N$_{50}$ scaffold length (Mb)$^a$ | 3 | 1.2 | 2.3 |
| Percent GC | 42.0 | 42.9 | 42.3 |
| Coding genes | 5983 | 5533 | 5841 |
| Gene density (per Mb) | 453.9 | 514.8 | 378.3 |
| Avg. gene length (nt) | 1786 | 1650 | 1627 |
| Avg. transcript length (nt) | 1720 | 1614 | 1568 |
| Avg. protein length (aa) | 451 | 447 | 493 |
| Avg. exon length (nt) | 1428 | 1332 | 1086 |
| Avg. intron length (nt) | 321 | 171 | 135 |
| Number of genes with introns | 994 (17%) | 974 (18%) | 1637 (28%) |

$^a$N$_{50}$ represents the scaffold size N at or above which 50% of all nucleotides are contained.

Xylose Consumers are Members of the 'CUG Clade' of Commensal Fungi.

Figure 2C:
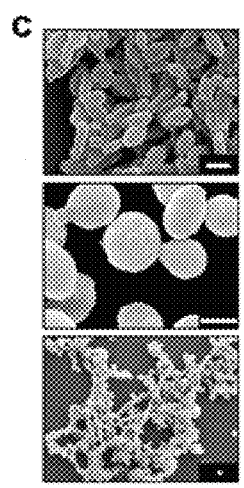
Figure 3:
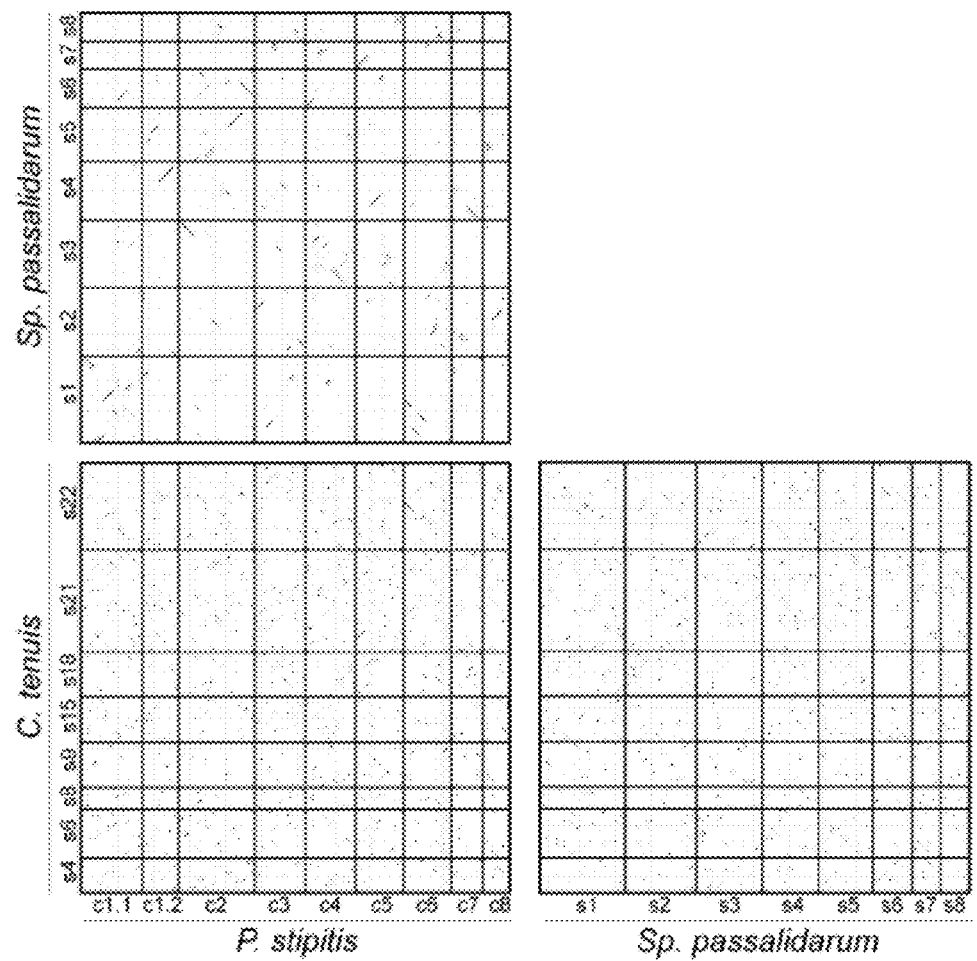
FIG. 3 illustrates pairwise genome-wide synteny dot plots for xylose-fermenting fungi. Diagonal lines display the homologous regions between the two genomes, either on the same strand (blue), or on opposite strands (red). Black grid lines indicate scaffold (s) or chromosome (c) boundaries. Longer regions of co-linearity exist between Spas and Psti, supporting the constructed species phylogeny.

Eleven other Ascomycetes with available genome sequences (Table 1) were selected for comparison to Spas, Cten, and Psti (FIG. 2B-C). Whole-genome phylogenetic analysis placed both Spas and Cten within the 'CUG clade' of yeasts (FIG. 2B), named for the alternative decoding of the CUG codon as serine instead of leucine (Ohama et al., species outside the CUG clade are decoded as leucine in orthologous Scer genes (FIG. 4B). Together, these results support the phylogenetic placement of xylose-fermenting species within the CUG clade. Most other species in this CUG group are commensal with humans but can emerge as opportunistic pathogens (Lockhart et al., *J Clin Microbiol* 46:374-376 (2008); Pfaller & Diekema *Clin Microbiol Rev* 20:133-163 (2007)). Thus, commensalism, albeit in association with different hosts, appears to be a feature common to this clade.

Clade-Specific Patterns of Gene Presence.

To identify genes associated with xylose utilization, gene content was compared between the fourteen Ascomycetes in the phylogeny by assigning orthology and paralogy relationships among the meta-set of 81,907 predicted fungal protein-coding genes. Over 12,000 orthologous gene groups (OGGs) were resolved, with 5,749 OGGs (91% of all genes) found in at least two species (Table 3 and FIG. 5A). In contrast, the other OGGs (52% of all OGGs representing 9% of all genes) are species-specific paralogs that are distributed non-randomly throughout the phylogeny (FIG. 5B). Within the CUG clade, *Debaryomyces hansenii* (Dhan) and *Pichia guilliermondii* (Pgui) have the most single-species expansions while the xylose-fermenting fungi (Spas, Cten and Psti) have some of the fewest. Interestingly, amplifications in the xylose-fermenters include sugar transporters and cell-surface proteins, which could be related to their unique sugar environment (Tables 4 and 5).

TABLE 3

Summary of OGG statistics.

| Type of OGG | Number of OGGs | Number of Genes |
|---|---|---|
| Multi-species OGGs | 5749 (47.8%) | 74633 (91.1%) |
| High-confidence | 5601 | 65916 |
| Unresolved | 148 | 8648 |
| Single-species OGGs | 6289 (52.2%) | 7274 (8.9%) |
| Expansions | 381 | 1366 |
| Orphans | 5908 | 5908 |
| Total dataset | 12038 | 81907 |

TABLE 4

Gene families with ≥10 members that are expanded ≥3-fold in one of the xylose-fermenting species.

| ClusterID[a] | # Spas | # Cten | # Psti | Predominant Pfam domain description |
|---|---|---|---|---|
| 11 | 24 | 1 | 3 | *Candida* agglutinin-like (ALS) |
| 22 | 1 | 0 | 18 | None |
| 23 | 1 | 14 | 4 | Major Facilitator Superfamily |
| 32 | 3 | 3 | 10 | Major Facilitator Superfamily |
| 42 | 1 | 2 | 11 | Sugar (and other) transporter |
| 47 | 12 | 1 | 1 | Glycosyltransferase sugar-binding region containing DXD motif |
| 61 | 0 | 0 | 12 | None |
| 62 | 10 | 1 | 1 | Leucine Rich Repeat |
| 81 | 11 | 0 | 0 | None |
| 83 | 10 | 0 | 0 | None |
| 86 | 0 | 0 | 10 | Leucine Rich Repeat |

[a]ClusterID refers to cluster number as found on JGI web portal (http://www.jgi.doe.gov/).

TABLE 5

Top 50 Pfam domain gene families in the xylose-fermenting species.

| Pfam Domain | Spas | Cten | Psti | Description |
|---|---|---|---|---|
| PF07690.7 | 92 | 130 | 145 | Major Facilitator Superfamily (MFS) |
| PF00069.16 | 83 | 85 | 90 | Protein kinase domain |
| PF00400.23 | 79 | 67 | 71 | WD domain, G-beta repeat |
| PF00271.22 | 59 | 49 | 56 | Helicase conserved C-terminal domain |
| PF00172.9 | 58 | 85 | 86 | Fungal Zn(2)-Cys(6) binuclear cluster domain |
| PF00076.13 | 43 | 37 | 41 | RNA recognition motif. (a.k.a. RRM, RBD, or RNP domain) |
| PF00083.15 | 38 | 49 | 53 | Sugar (and other) transporter |
| PF00106.16 | 35 | 45 | 32 | Short chain dehydrogenase |
| PF00096.17 | 34 | 37 | 37 | Zinc finger, C2H2 type |
| PF00270.20 | 34 | 30 | 34 | DEAD/DEAH box helicase |
| PF00153.18 | 33 | 32 | 34 | Mitochondrial carrier protein |
| PF00005.18 | 31 | 24 | 30 | ABC transporter |
| PF00560.24 | 31 | 16 | 30 | Leucine Rich Repeat (LRR) |
| PF04082.9 | 30 | 33 | 48 | Fungal specific transcription factor domain |
| PF01370.12 | 30 | 17 | 20 | NAD-dependent epimerase/dehydratase family |
| PF00324.12 | 29 | 30 | 36 | Amino acid permease |
| PF00004.20 | 29 | 30 | 31 | ATPase family associated with various cellular activities (AAA) |
| PF00646.24 | 29 | 14 | 14 | F-box domain |
| PF08477.4 | 28 | 30 | 33 | Miro-like protein |
| PF02985.13 | 28 | 27 | 30 | HEAT repeat |
| PF00071.13 | 27 | 25 | 28 | Ras family |
| PF00097.16 | 27 | 25 | 25 | Zinc finger, C3HC4 type (RING finger) |
| PF01073.10 | 26 | 13 | 16 | 3-beta hydroxysteroid dehydrogenase/isomerase family |
| PF07993.3 | 26 | 12 | 14 | Male sterility protein |
| PF05792.4 | 24 | 1 | 6 | *Candida* agglutinin-like protein (ALS) |
| PF00226.22 | 23 | 22 | 24 | DnaJ domain |
| PF00018.19 | 21 | 19 | 22 | SH3 domain |
| PF08241.3 | 19 | 16 | 15 | Methyltransferase domain |
| PF07719.8 | 19 | 13 | 15 | Tetratricopeptide repeat |
| PF00702.17 | 18 | 21 | 19 | Haloacid dehalogenase-like hydrolase |
| PF08240.3 | 18 | 19 | 23 | Alcohol dehydrogenase GroES-like domain |
| PF00248.12 | 18 | 17 | 17 | Aldo/keto reductase family |
| PF08242.3 | 18 | 13 | 16 | Methyltransferase domain |
| PF00515.19 | 18 | 11 | 14 | Tetratricopeptide repeat |
| PF00149.19 | 17 | 19 | 18 | Calcineurin-like phosphoesterase |
| PF00176.14 | 17 | 18 | 18 | SNF2 family N-terminal domain |
| PF00561.11 | 17 | 16 | 22 | Alpha/beta hydrolase fold |
| PF07728.5 | 17 | 14 | 15 | ATPase family associated with various cellular activities (AAA) |
| PF01794.10 | 17 | 8 | 10 | Ferric reductase like transmembrane component |
| PF07653.8 | 16 | 14 | 16 | Variant SH3 domain |
| PF00023.21 | 16 | 13 | 14 | Ankyrin repeat |
| PF08030.3 | 16 | 7 | 9 | Ferric reductase NAD binding domain |
| PF00107.17 | 15 | 17 | 21 | Zinc-binding dehydrogenase |
| PF00300.13 | 15 | 15 | 12 | Phosphoglycerate mutase family |
| PF01423.13 | 15 | 14 | 12 | LSM domain |
| PF08022.3 | 15 | 5 | 8 | FAD-binding domain |
| PF01266.15 | 14 | 19 | 15 | FAD-dependent oxidoreductase |
| PF00227.17 | 14 | 14 | 14 | Proteasome A-type and B-type |
| PF00443.20 | 14 | 14 | 14 | Ubiquitin carboxyl-terminal hydrolase |

Conservation patterns of the 5,749 multi-species OGGs were analyzed through a clustering approach, which identified clade-specific OGGs enriched for different functional properties (FIG. 6A and Table 6). Approximately half of the multi-species OGGs are common to all 14 Ascomycetes. These ubiquitous OGGs are significantly enriched for essential metabolic processes including nucleic acid ($p=1.32e-42$, hypergeometric distribution), small molecule ($p=6.28e-35$), and protein ($p=2.51e-14$) metabolism, as well as transcription ($p=2.76e-23$) and response to stress ($p=1.30e-31$).

The remaining OGGs can be clustered into five major clade-specific groups. Remarkably, the majority of clade-specific OGGs (including those unique to well-studied fungi such as Scer) are significantly enriched for unclassified and uncharacterized proteins ($p=4.271e-21$). This finding reveals a general bias in our understanding of gene function and highlights the dearth of information on species-specific processes, even for the best characterized organisms like Scer.

OGGs unique to the CUG clade are enriched for genes encoding lipases and cell-surface proteins ($p=1.306e-6$ and $6.665e-6$, respectively), as previously noted in *Candida* species (Butler et al. *Nature* 459:657-662 (2009)). Although enrichment of these genes in *Candida* species was previously interpreted to be important for pathogenicity (Butler et al. (2009) supra), their presence in beetle symbionts suggests they may be relevant to commensalism, rather than pathogenicity per se. Additionally, many genes unique to CUG yeasts are involved in de novo $NAD^+$ biosynthetic processes ($p=0.00891$), suggesting novel metabolism that may reflect a more complex environment of these commensal organisms.

TABLE 6

Summary of functional enrichment of species-specific orthologues.

| Description | Number of OGGs in Cluster | Significant Annotation | p-value[a] | Fold Enrichment |
|---|---|---|---|---|
| 1 Unique to Spom and Ylip | 114 | No significant enrichment | | |
| 2 Unique to Scer, Cgla, and Klac | 341 | Metosis | 3.379e−8 | 3.5x |
| | | M phase | 7.234e−13 | 3.0x |
| | | Cell cycle phase | 7.308e−13 | 2.8x |
| | | Unclassified | 4.271e−21 | 1.7x |
| 3 Unique to CUG yeasts | 247 | de novo NAD biosynthetic process | 0.00891 | 22.3x |
| | | Lipase activity | 1.306e−6 | 9.2x |
| | | Extracellular region | 6.665e−6 | 6.2x |
| | | Unclassified | 4.274e−21 | 1.5x |
| 4 Absent in Spom only | 363 | α-1,3-mannosyltransferase activity | 0.000249 | 12.0x |
| | | Lipid/fatty acid catabolic process | 0.000438 | 4.4x |
| | | Peroxisome | 0.00014 | 3.2x |
| | | Unclassified | 0.001 | 1.3x |
| 5 Absent in Spom and Ylip | 150 | No significant enrichment | | |

[a]Bonferroni-corrected p-values of enrichment (hypergeometric distribution).

Figure 17:
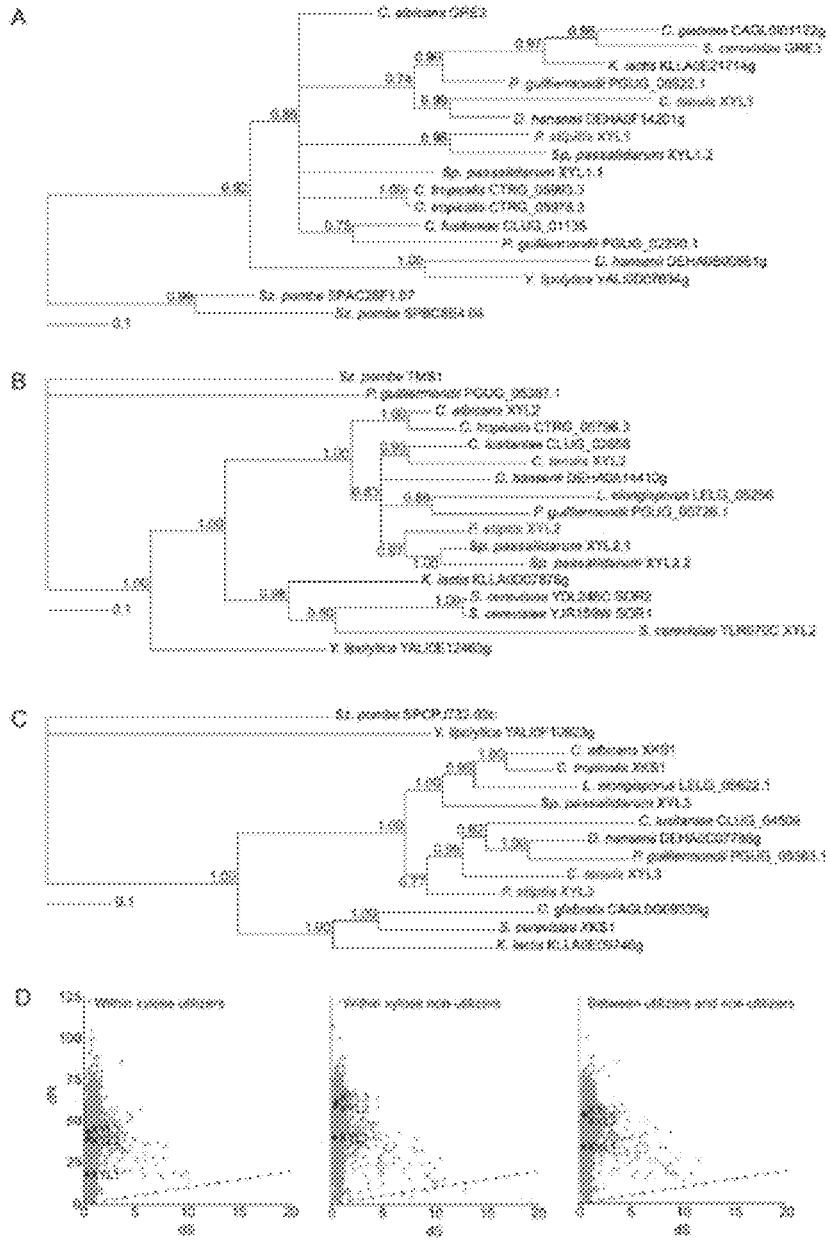
FIG. 17A-D illustrate known xylose-utilization genes are present throughout the Ascomycetes. Bayesian gene trees were reconstructed for the XYL1 (A), XYL2 (B), and XYL3 (C) OGGs using MrBayes. Posterior probabilities are indicated on all branches. (D) Plots of dS versus dN for 2664 OGGs present in both xylose utilizers and non-utilizers. Measurements of dN and dS were computed between all pairs of all genes in each OGG with PAML v4.3. The average dN and dS was calculated for all pairs of genes within the xylose utilizers, within the xylose non-utilizers, and between the xylose utilizers and non-utilizers. The dashed line indicates dN/dS=1.

Surprisingly, orthologs of known xylose-utilization genes are present in all 14 Ascomycetes, even though most Hemiascomycetes cannot utilize xylose (Jeffries & Kurtzman (1994) supra). This group includes orthologs of Psti xylose reductase (XYL1; Rizzi et al. (1988) supra), xylitol dehydrogenase (XYL2; Rizzi et al. (1989) supra), and xylulokinase (XYL3; Deng & Ho (1990) supra), the minimal set of genes required to engineer Scer for xylose assimilation (FIG. 2A; Jeffries (2006) supra; Van Vleet & Jeffries (2009) supra; Kotter & Ciriacy (1993) supra). However, these genes show no evolutionary signatures of selection or constraint to suggest functional modification in the xylose-utilizing species (FIG. 17). Thus, other factors must contribute to phenotypic differences in xylose consumption besides the mere presence of this 'minimal' gene set.

Conservation of Orthologous Gene Groups Points to Novel Xylose Utilization Genes.

Figure 8:
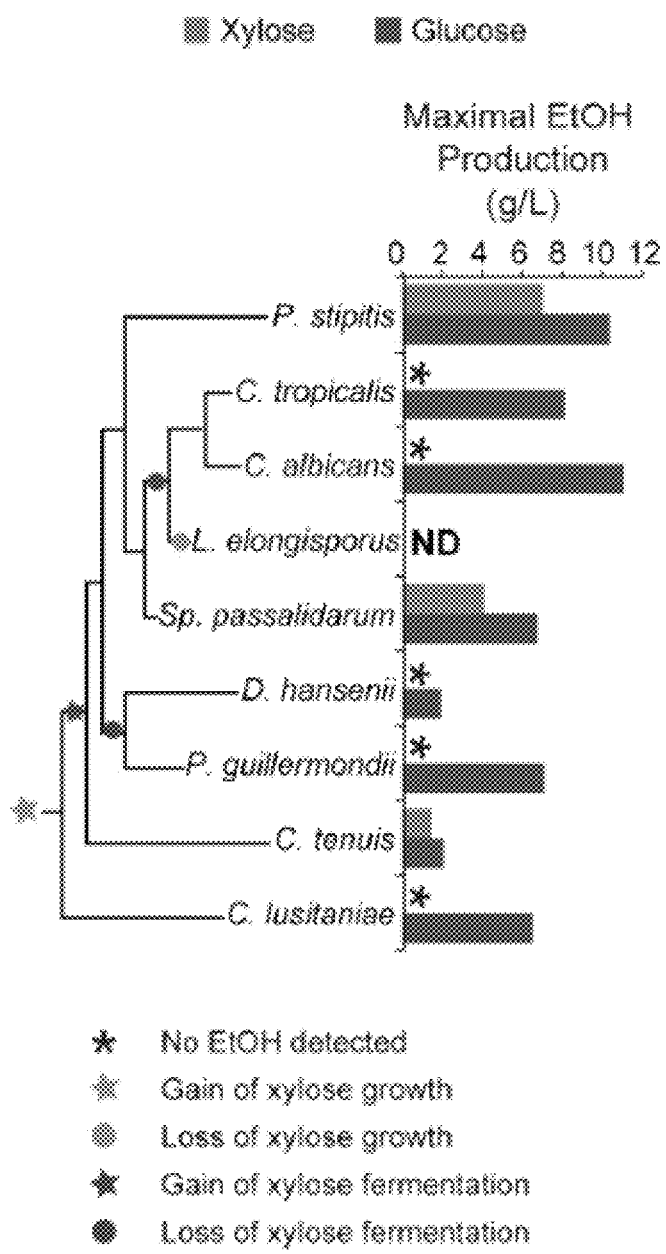
FIG. 8 illustrates maximal EtOH production from 8% xylose (green) or 8% glucose (purple) over 55 hours. High-density cultures were grown in a microaerobic environment (minimal shaking at 30° C.), and EtOH concentration was measured by gas chromatograph every eight hours. Values represent three biological replicates. Limit of EtOH detection is 0.2 g/L. The most parsimonious explanation for evolution of xylose growth and fermentation is indicated with orange and blue symbols, respectively. ND, no data was measured for Lelo, as it does not grow on xylose.
Figure 9:
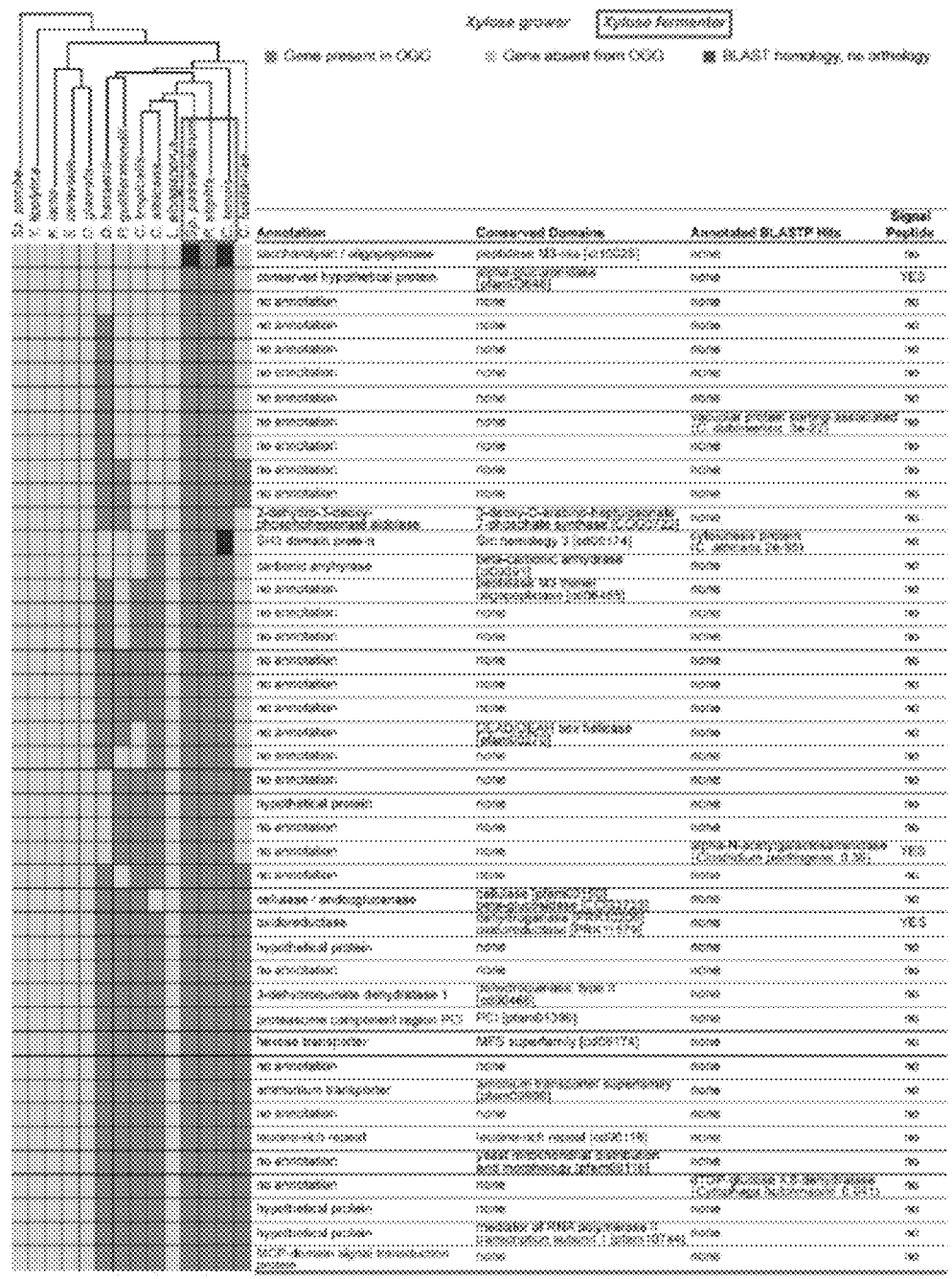
FIG. 9 illustrates a comparison of the 43 OGGs present in all xylose-growing species and absent from all species unable to grow on xylose. The amino acid sequence of each gene in Psti, Spas, and Cten was examined by BLAST47 against the NCBI non-redundant database to identify conserved protein domains, and by SignalP v3.069 to identify signal peptide sequences. The summary of these analyses is given in the table adjacent to the image showing patterns of OGG presence (orange), absence (grey), and BLAST homology despite no ortholog call (blue) across the phylogeny. For annotated BLASTP hits, the species in which the BLAST hit occurred and the E-value is given.

To identify genes relevant to xylose fermentation, a phylogenetic approach was used to correlate genotype to phenotype across the Ascomycetes. First, xylose growth and fermentation were examined (FIG. 6B and FIGS. 7 and 8). Psti, Spas, and Cten were the only species able to measurably ferment xylose in our assay (FIG. 8). These are also the yeasts associated with beetles, many of which are attracted to fermentation byproducts (Hammons et al. *Proc Natl Acad Sci USA* 106:3686-3691 (2009)). Only three genes are uniquely found in these xylose-fermenting species, one of which contains an α-glucuronidase domain and a signal peptide sequence indicative of secretion (FIG. 9). While its connection to xylose utilization is not clear, this protein may be secreted for degradation of complex carbohydrates in woody biomass.

The inventors expanded their analysis to consider xylose assimilation. Notably, *L. elongisporus* (Lelo) is the lone member of the CUG clade unable to grow on xylose (FIG. 6B), suggesting that the phenotype was present in the group's common ancestor but lost in this lineage. Because genes involved in sugar metabolism are not maintained in the absence of selection (Hittinger et al. *Nature* 464:54-58 (2010); Hittinger *Proc Natl Acad Sci USA* 101:14144-14149 (2004)), the inventors reasoned that species unable to grow on xylose may have lost key assimilation genes. The inventors therefore looked for genes whose presence and absence across the fungi correlated with the ability to grow on xylose.

TABLE 7

Number of significantly differentially expressed genes in each species.

| | Number of Significant Genes[a] | | |
|---|---|---|---|
| | Induced | Repressed | Total |
| *P. stipitis* | 170 | 219 | 389 |
| *Sp. passalidarum* | 198 | 143 | 341 |
| *C. tenuis* | 427 | 508 | 935 |
| *C. albicans* | 499 | 554 | 1053 |
| *L. elongisporus* | 952 | 869 | 1821 |

[a]Significance determined with Limma[65] by paired t-tests within each species; FDR = 0.05.

TABLE 8

Fourteen significantly differentially expressed genes common to all three xylose-fermenters.

| Annotation | Psti | Spas | Cten | Calb | Lelo |
|---|---|---|---|---|---|
| EGC2 endo-1,4-beta-glucanase (cellulase) | 6.77 | 6.47 | 1.04 | | |
| BGL7 beta-glucosidase | 2.38 | 0.46 | 0.74 | 0.30 | |
| BGL5 beta-glucosidase | 0.86 | 1.19 | 2.17 | 0.30 | |
| beta-glucosidase family 3 | 0.77 | 1.19 | 0.74 | 0.30 | |
| vacuolar transporter chaperone 1 | 0.58 | 0.38 | 0.78 | 0.24 | 0.00 |
| transcription regulatory protein | −0.59 | 0.24 | −0.59 | 0.56 | −0.09 |
| protein kinase | 0.32 | −0.16 | −0.90 | 0.42 | −0.20 |
| chromatin remodeling protein | 0.55 | −0.54 | −0.41 | −0.33 | 0.04 |
| XYL1 NAD(P)H-dependent D-xylose reductase | 7.38 | 4.92 | 3.97 | 5.22 | 0.61 |
| RGT2 high-affinity glucose transporter | 3.73 | 3.20 | 3.69 | 5.33 | 0.33 |
| XYL3 D-xylulokinase | 3.59 | 4.41 | 1.22 | 3.16 | 0.88 |
| GAL10 UDP glucose-4-epimerase | 3.09 | 3.13 | 2.29 | 1.63 | 2.52 |
| XYL2 xylitol dehydrogenase | 4.97 | 6.80 | 3.89 | 4.47 | 5.21 |
| oxidoreductase | 1.67 | 2.16 | 0.65 | 3.75 | 2.30 |

Values given are log$_2$ fold-change of xylose versus glucose expression.
Red text indicates statistically significant measurement (Limma t-test[65], FDR = 0.05).
Blank cell indicates no ortholog present.

TABLE 9

Lelo-specific clusters are enriched for Scer stress response genes.

| Cluster | Num. Lelo Genes in Cluster | Scer class | Enrichment | p-value[a] |
|---|---|---|---|---|
| Induced in Lelo | 1137 | Induced stress response | 2.9x | 1.34e−30 |
| Repressed in Lelo | 1168 | Repressed stress response | 4.0x | 2.98e−168 |

[a]Bonferroni-corrected p-values of enrichment (hypergeometric distribution).

TABLE 10

Summary of functional enrichment of Cten-Calb-Lelo expression cluster.

| GO Term | Frequency in Cluster | Frequency in Genome | Enrichment | p-value[a] |
|---|---|---|---|---|
| Fatty acid metabolic process | 9/88 | 38/6848 | 17x | 1.39e−7 |
| Carboxylic acid metabolic process | 17/88 | 250/6840 | 5.2x | 2.35e−6 |
| Lipid catabolic process | 6/88 | 19/6840 | 22.7x | 1.64e−5 |

[a]Bonferroni-corrected p-values of enrichment (hypergeometric distribution).

Forty-three genes were absent in xylose non-growers but common to all xylose fermenters, with varying conservation across species that could assimilate xylose (FIG. 6C). Fifteen showed presence and absence patterns that strictly correlated with xylose assimilation. These include orthologs of a putative Psti xylose transporter and several endoglucanases that break down higher-order sugars in hemicellulose. Most other genes are unannotated and fungal specific; ten are also found in other fungi capable of plant cell wall degradation. However, two of the proteins have signal peptide sequences: an oxidoreductase and a putative glycoside hydrolase, both of which could be potentially useful for biomass degradation (see FIG. 9 for protein domain and signal peptide analysis). Although the conservation of these genes is suggestive of functional importance, we did not detect any signatures of constraint within the xylose fermenters.

Cross-Species Genomic Expression Identifies Additional Xylose-Responsive Genes.

As a second approach to identify xylose metabolism genes, we characterized genomic expression during glucose versus xylose growth in five species including the three xylose-fermenters, xylose-growing *C. albicans* (Calb), and Lelo, which is unable to grow on xylose. We performed a comparative analysis of orthologous gene expression via hierarchical clustering (FIG. 10 and FIG. 11) and significance testing (Tables 7 and 8). The xylose response was strikingly dissimilar across species (FIG. 10A). In particular, Lelo altered the expression of thousands of genes, including orthologs of the yeast environmental stress response (ESR) that are induced when Scer is stressed (Gasch et al. *Mol Biol Cell* 11:4241-4257 (2000)) or experiences xylose (FIG. 11A and Table 9; Wenger et al., *PLoS Genet* 6:e1000942 (2010)). This massive expression pattern in Lelo likely represents a starvation response to carbon limitation, and demonstrates that the ESR is conserved in this species. In addition, Lelo, along with Cten and Calb, induced ~90 OGGs enriched for fatty acid and lipid catabolism, suggesting reliance on fatty acids as a carbon source (FIG. 11B and Table 10). Two clusters of genes induced by xylose in most or all species, regardless of their xylose growth phenotypes, were identified (FIG. 10B-C).

These include genes whose expression is required for optimal xylose utilization in engineered Scer (e.g. XYL1, XYL2, XYL3, TKL1, and TAL1; FIG. 2A). Several of these genes were strongly induced in Lelo, even though it cannot utilize xylose. Thus, remnants of the xylose signaling cascade persist in Lelo, despite recent loss of xylose assimilation.

In addition to known xylose metabolism genes, others relating to carbohydrate transport and metabolism were highly induced specifically in xylose growers. Genes encoding beta-glucosidases and cellulases were strongly induced, suggesting that xylose participates in a positive feedback loop to catalyze its own release from hemicellulose. Orthologs of genes metabolizing other carbohydrates (including galactose, maltose, and glucose) were also up-regulated. Thus, in their native environment these species may not encounter free xylose in the absence of complex sugars, and are unlikely to rely on it as a sole carbon source. Additionally, the xylose-fermenting species induced several genes linked to redox regeneration, a well-known bottleneck in Scer engineered for xylose fermentation (Jeffries (2006) supra; Van Vleet & Jeffries (2009) supra). Genes encoding NADPH-generating steps of the pentose phosphate pathway (ZWF1 and PGI1) were up-regulated, perhaps to feed NADPH-consuming xylose reductase. Other genes implicated in $NAD(P)^+/H$ recycling or oxido-reduction were also induced and may function to maintain redox balance during xylose assimilation.

Candidate Genes Improve Xylose Utilization.

Figure 12C:
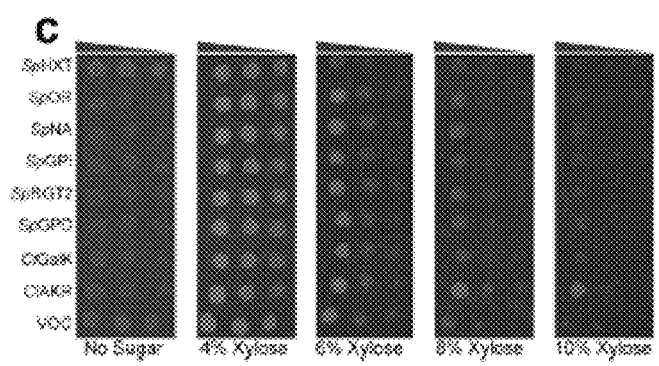
Figure 15:
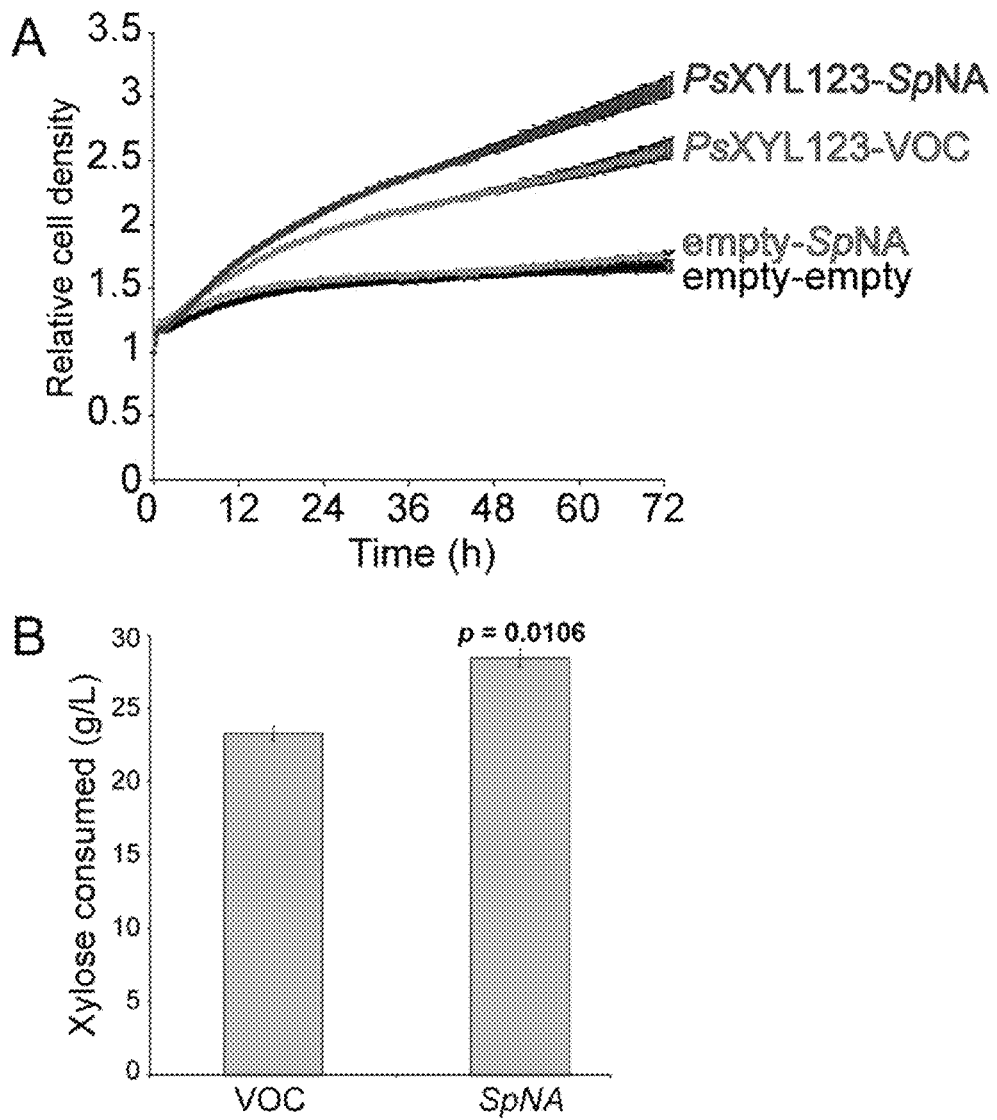
FIG. 15A-B show SpNA improves Scer xylose consumption. (A) Average±SD (n=4) growth on 8% xylose of BY4741 engineered with PsXYL1,2,3 and harboring SpNA (red) or the empty vector (VOC, orange). Corresponding strains without PsXYL1,2,3 but harboring SpNA (grey) or empty vector (black) are also shown. (B) Average±SD (n=3) xylose consumed after 72 hours growth for BY4741-PsXYL123-SpNA or empty vector control (VOC).

Ten of the genes implicated above were tested for their ability to enhance xylose utilization in two different engineered Scer strains. Genetic background influenced the effect of over-expression, and several genes improved growth on both xylose and glucose (FIG. 12), including a putative hexose transporter (SpHXT) and a glucose-6-phosphate dehydrogenase (SpGPD). Two genes had a specific positive effect on xylose utilization in one or both strain backgrounds: a Cten aldo/keto reductase, CtAKR, and a Spas unannotated protein, SpNA, with homology to uncharacterized fungal-specific proteins (FIG. 13 and FIG. 15).

Figure 16:
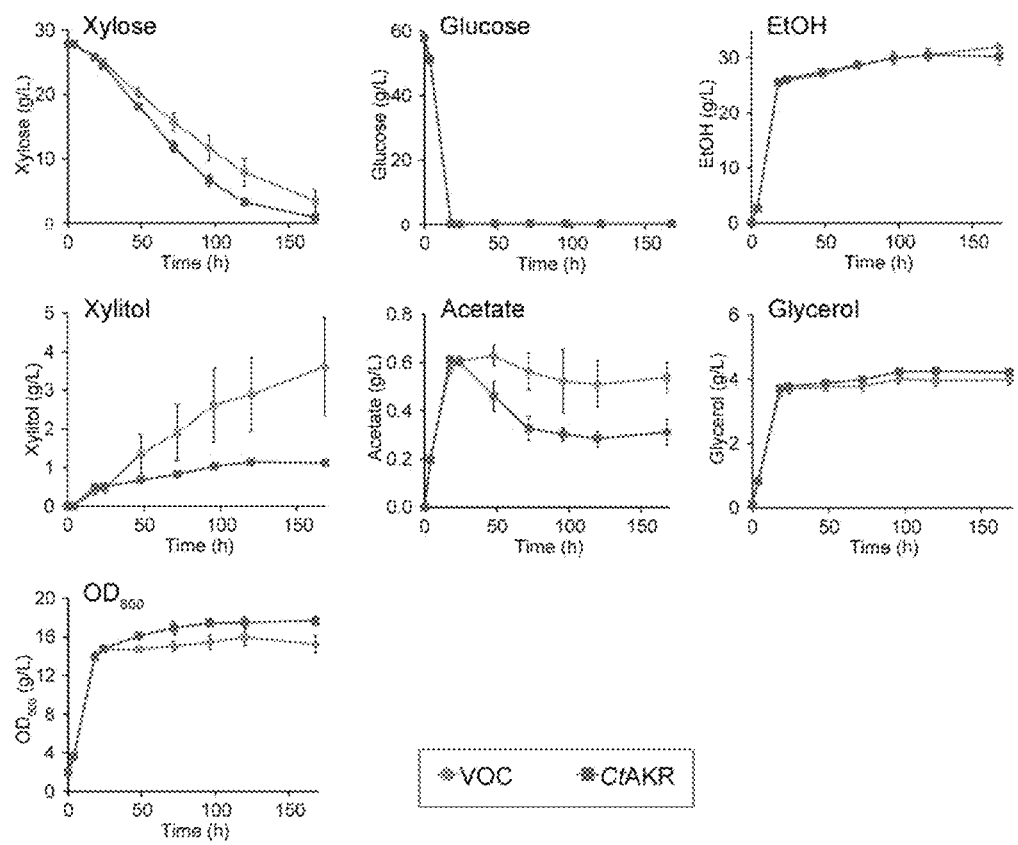
FIG. 16 shows CtAKR improves Scer xylose consumption during anaerobic fermentation. GLBRCY2A-PsXYL123 strains harboring CtAKR (purple) or the empty vector (grey) were grown anaerobically for 168 h. Average±SD (n=3) xylose and glucose consumed, EtOH, xylitol, acetate, and glycerol produced, and OD600 are shown.

Expression of plasmid-born CtAKR significantly improved xylose consumption during both aerobic and anaerobic growth (FIG. 13B). Xylose consumption increased by 32% after 72 h of anaerobic fermentation (p=0.0369, t-test). At the same time, xylitol production relative to xylose consumption was 73% lower (FIG. 13C) indicating improved flux through the xylose-assimilation pathway. Glycerol production, which represents a significant drain on ethanol production under anaerobic conditions (Guadalupe Medina et al. *Appl Environ Microbiol* 76:190-195 (2010); Wang et al. *Biotechnol Adv* 19:201-223 (2001)), was not significantly increased (FIG. 16). However, acetate production was reduced 42% (FIG. 13C). Because acetate is a weak acid stress for yeast, lower acetate levels could facilitate increased cell growth. Indeed, some of the increased xylose utilization went into biomass production (FIG. 16); however, the improved xylose utilization did not increase ethanol titers, revealing that ethanol production was not limited by carbon availability, but by other factors. Nonetheless, the significant effect of pCtAKR on anaerobic xylose assimilation and concomitant reduction in xylitol represents a major advance in cellulosic biomass conversion by Scer.

Figure 14:
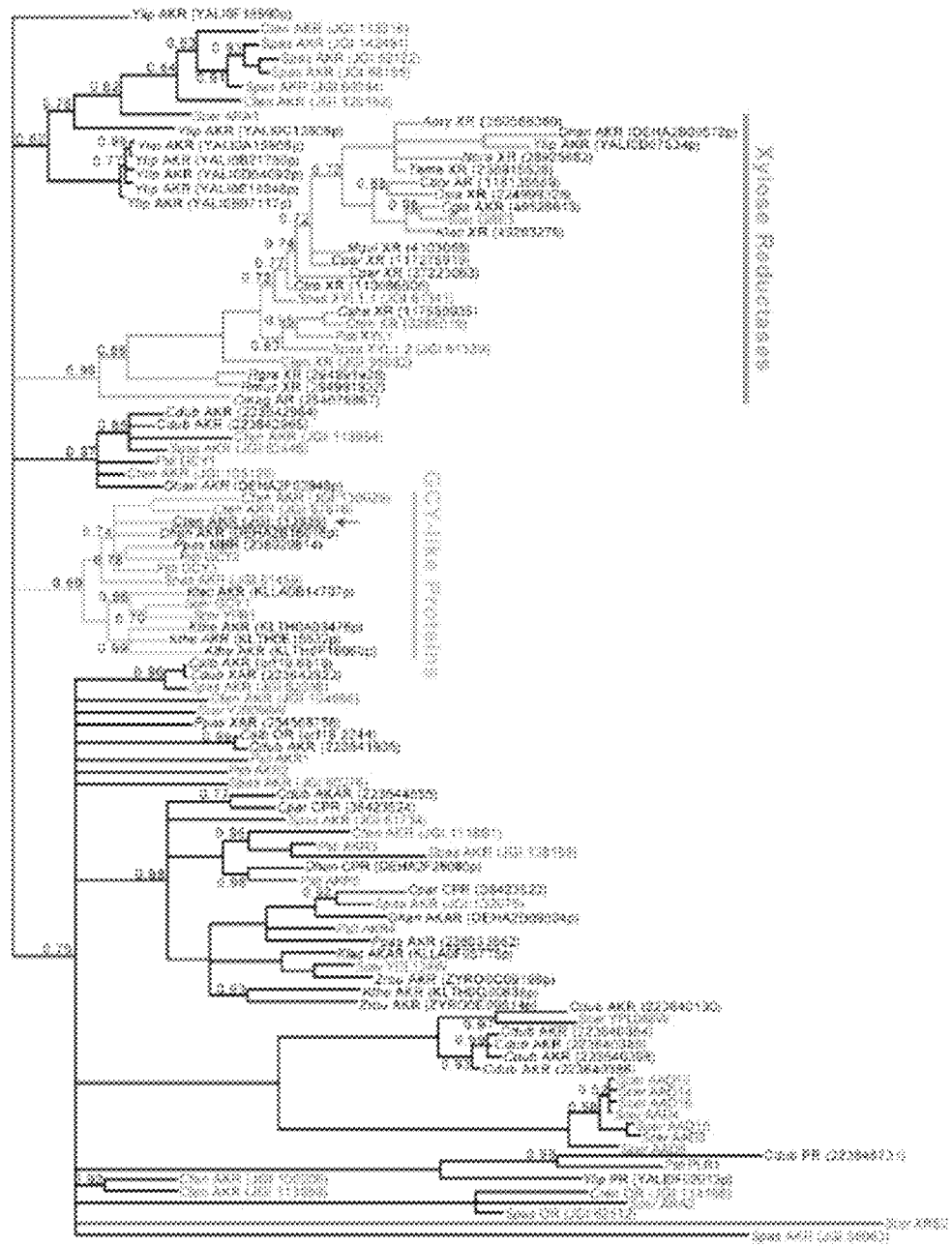
FIG. 14 illustrates a gene tree of fungal aldo/keto reductases (AKRs). Amino acid sequences of Ascomycete AKRs were obtained from the NCBI database. A Bayesean phylogeny was reconstructed using MrBayes. For simplicity, only those posterior probabilities not equal to one are shown on corresponding branches. The Cten AKR engineered into Scer is indicated with a red arrow. Cten, red text; Spas, blue text; Psti, green text; Scer, purple text.
Figure 18:
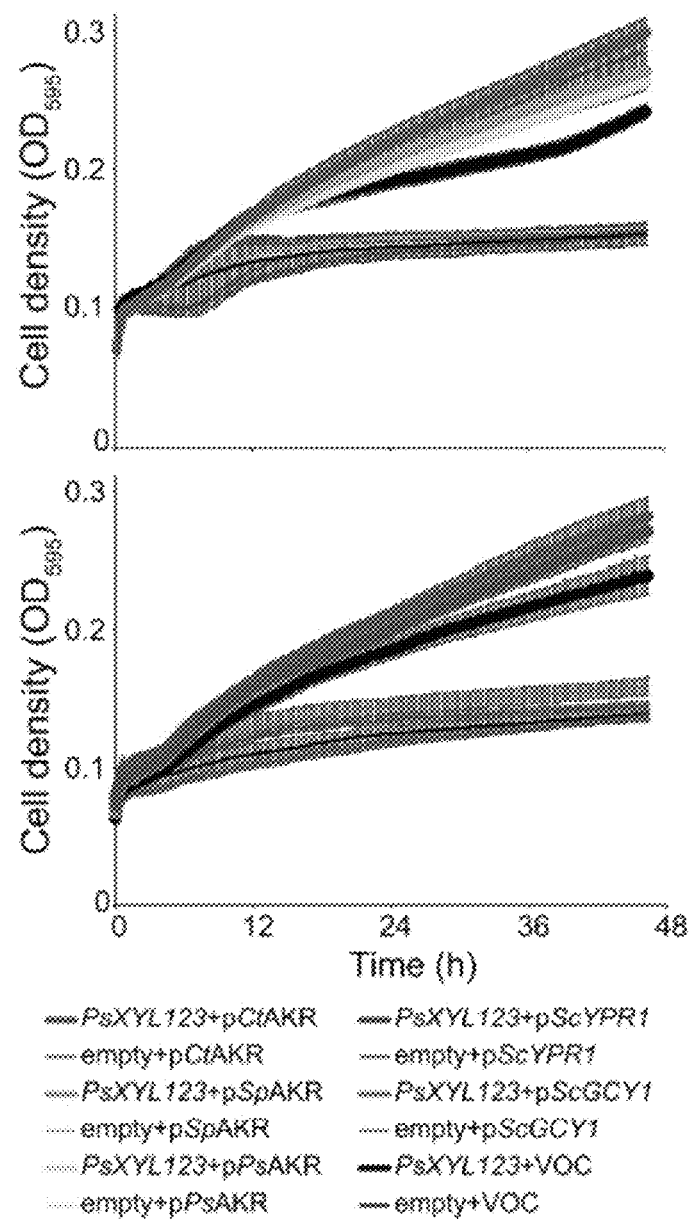
FIG. 18 illustrates CtAKR orthologs from different species improve xylose growth. Average±SD (n=4) growth on 8% xylose of GLBRCY0A harboring PsXYL123 (thick lines) and GLBRCY0A lacking PsXYL123 ('empty'; thin lines), and carrying pCtAKR (red), the Spas AKR ortholog (pSpAKR; orange), the Psti AKR ortholog (pPsAKR; yellow), Scer YPR1 (pScYPR1; purple), Scer GCY1 (pScGCY1; pink), or a vector-only control (VOC; black).

CtAKR is a member of the large protein family that includes xylose reductases (FIG. 14). However, CtAKR is most similar to the $NADP^+$-dependent glycerol dehydrogenase Gcy1 from Scer, which functions in an alternative pathway for glycerol catabolism (FIG. 2A; Norbeck & Blomberg, *J Biol Chem* 272:5544-5554 (1997)). Notably, CtAKR contains residues known to establish $NADP^+$ binding; reviewed in Sanli et al. *Cell Biochem Biophys* 38:79-101 (2003)), suggesting CtAKR may also function in a NADP+-specific manner. The inventors examined the effect of pCtAKR expression on glycerol metabolism in a Scer mutant lacking three functionally redundant AKRs (GCY1, YPR1, GRE3; *Materials and Methods*). Glycerol levels increased in the mutant strain but were restored to wild-type levels by pCtAKR (FIG. 13D). Together, these data suggest that CtAKR functions as a NADP+-dependent glycerol dehydrogenase in Scer. Indeed, like CtAKR, over-expression of Scer GCY1 or YPR1 had a positive effect on xylose utilization (FIG. 18), further supporting the inventor's hypothesis for CtAKR function.

The inventors have further demonstrated that orthologs from other yeasts of CtAKR can also improve xylose utilization. In particular, they have shown that AKRs from Sp. *passalidarum* (SpAKR), *P. stipitis* (PsAKR), and *S. cerevisiae* (ScGCY1 and ScYPR1) also improve xylose utilization in the disclosed engineered strain of *S. cerevisiae*. Accordingly, the inventors have evidence that the xylose-utilization improvement comes from this general family of genes and is not limited to the *C. tenuis* gene.

Example 2

Characterization of SpNA, SpXUT and CtAKR

Ten of the genes implicated above were tested for their ability to enhance xylose utilization in two different engineered Scer strains. This example describes characterization, particularly xylose fermentation enhancing bioactivity, of three different genes (SpNA, SpXUT, CtAKR) expressed on a plasmid in two different *S. cerevisiae* strains. The strains are described in Table 11.

TABLE 11

Strains used to characterize SpNA, SpXUT and CtAKR.

| Strain* | *S. cerevisiae* Background | Engineered Gene |
|---|---|---|
| BY-NA | BY + PsXYL123 (GLBRCY6A) | SpNA |
| BY-XUT | BY + PsXYL123 (GLBRCY6A) | SpXUT |
| BY-AKR | BY + PsXYL123 (GLBRCY6A) | CtAKR |
| CRB-NA | CRB + PsXYL123 (GLBRCY2A) | SpNA |
| CRB-XUT | CRB + PsXYL123 (GLBRCY2A) | SpXUT |
| CRB-AKR | CRB + PsXYL123 (GLBRCY2A) | CtAKR |

*The notation BY = BY4741; the notation CRB = YB210.

Each strain background carries the *P. stipitis* XYL123 cassette (PsXYL123) integrated into the genome under high-copy promoters, which is required for *S. cerevisiae* to utilize xylose. For testing the Sp. *passalidarum* and *C. tenuis* genes, each gene was engineered into a 2-micron plasmid (pRS426 based construct without the URA3 marker).

Various activity assays were performed to assess strain xylose utilization improvement over a vector-only control strain, which is summarized in Table 12.

TABLE 12

Xylose utilization and ethanol production of SpNA, SpXUT and CtAKR strains.

| | GROWTH | | XYLOSE CONSUMPTION | | ETOH PRODUCTION Improved EtOH |
|---|---|---|---|---|---|
| | Improved xylose growth (aerobic, liquid) | Improved xylose growth (solid) | Improved xylose consumption (aerobic, liquid) | Improved xylose consumption (anaerobic, liquid) | production from xylose (anaerobic, liquid) |
| BY-NA | YES | no | YES | no | no |
| BY-XUT | no | no | NT* | no | no |
| BY-AKR | YES | YES | NT | YES | no |
| CRB-NA | YES | no | NT | YES | no |
| CRB-XUT | YES | YES | YES | YES | no |
| CRB-AKR | YES | YES | YES | YES | no |

*NT = not yet tested;

Genetic background influenced the effect of over-expression, and several genes improved growth on both xylose and glucose (FIG. 12), including a putative hexose transporter (SpHXT) and a glucose-6-phosphate dehydrogenase (SpGPD). Two genes had a specific positive effect on xylose utilization in one or both strain backgrounds: a Cten aldo/keto reductase, CtAKR, and a Spas unannotated protein, SpNA, with homology to uncharacterized fungal-specific proteins (FIG. 13 and FIG. 15).

Expression of plasmid-born CtAKR significantly improved xylose consumption during both aerobic and anaerobic growth (FIG. 13B). Xylose consumption increased by 32% after 72 h of anaerobic fermentation (p=0.0369, t-test). At the same time, xylitol production relative to xylose consumption was 73% lower (FIG. 13C) indicating improved flux through the xylose-assimilation pathway. Glycerol production, which represents a significant drain on ethanol production under anaerobic conditions (Guadalupe Medina et al. *Appl Environ Microbiol* 76:190-195 (2010); Wang et al. *Biotechnol Adv* 19:201-223 (2001)), was not significantly increased (FIG. 16). However, acetate production was reduced 42% (FIG. 13C). Because acetate is a weak acid stress for yeast, lower acetate levels could facilitate increased cell growth. Indeed, some of the increased xylose utilization went into biomass production (FIG. 16); however, the improved xylose utilization did not increase ethanol titers, revealing that ethanol production was not limited by carbon availability, but by other factors. Nonetheless, the significant effect of pCtAKR on anaerobic xylose assimilation and concomitant reduction in xylitol represents a major advance in cellulosic biomass conversion by Scer.

CtAKR is a member of the large protein family that includes xylose reductases (FIG. 14). However, CtAKR is most similar to the NADP+-dependent glycerol dehydrogenase Gcy1 from Scer, which functions in an alternative pathway for glycerol catabolism (FIG. 2A; Norbeck & Blomberg, *J Biol Chem* 272:5544-5554 (1997)). Notably, CtAKR contains residues known to establish NADP$^+$ binding; reviewed in Sanli et al. *Cell Biochem Biophys* 38:79-101 (2003)), suggesting CtAKR may also function in a NADP$^+$-specific manner. The inventors examined the effect of pCtAKR expression on glycerol metabolism in a Scer mutant lacking three functionally redundant AKRs (GCY1, YPR1, GRE3; *Materials and Methods*). Glycerol levels increased in the mutant strain but were restored to wild-type levels by pCtAKR (FIG. 13D). Together, these data suggest that CtAKR functions as a NADP$^+$-dependent glycerol dehydrogenase in Scer. Indeed, like CtAKR, over-expression of Scer GCY1 or YPR1 had a positive effect on xylose utilization (FIG. 18), further supporting the inventor's hypothesis for CtAKR function.

Orthologs from other yeasts of CtAKR can also improve xylose utilization. In particular, AKRs from Sp. *passalidarum* (SpAKR), *P. stipitis* (PsAKR), and *S. cerevisiae* (ScGCY1 and ScYPR1) also improve xylose utilization in the disclosed engineered strain of *S. cerevisiae*. Accordingly, xylose-utilization improvement likely is associated with this general family of genes and is not limited to the *C. tenuis* gene.

Example 3

Discussion

Previous work aimed at improving Scer xylose fermentation focused on metabolic modeling (Sonderegger et al. *Appl Environ Microbiol* 70:2307-2317 (2004)), single-species genome and expression analysis (Sonderegger et al. (2004) supra; Otero et al. *BMC Genomics* 11:723 (2010)), or directed evolution (Wisselink et al. *Appl Environ Microbiol* 75:907-914 (2009)). The inventors utilized a comparative genomics approach to understand xylose utilization in several different beetle-associated fungi. This approach reveals that these species share some features with other commensal fungi, yet display specific traits (e.g., the ability to ferment xylose and expression of genes involved in cellulose degradation) that may be specific to their relationship with wood-boring insects. The ability to assimilate xylose is associated with altered expression of several genes central to glycolysis, xylose catabolism, and the pentose phosphate shuttle, revealing that decades of directed evolution have largely recapitulated the natural expression response in these species. That some aspects of this response were observed in species that cannot assimilate xylose (namely Lelo) indicates that remnants of the genomic expression program can remain long after the ability to consume the sugar has been lost.

Additionally, several induced genes are related to reducing potential. Indeed, one of the biggest challenges for xylose fermentation in Scer engineered with Psti XYL1,2,3 is the cofactor imbalance that emerges under anaerobic conditions. During anaerobic growth, NADH cannot be recycled through respiration, leading to a shortage of NAD$^+$ to supply Xyl2 and thus an accumulation of xylitol (Jeffries (2006) supra). To reduce this redox imbalance, Scer increases NADH-dependent glycerol production. We found that over-expression of a Cten glycerol dehydrogenase significantly increased flux through the xylose assimilation pathway, without the typical xylitol accumulation. The inventors hypothesize that CtAKR increases cycling through the glycerol metabolic pathway, producing NADPH through alternative glycerol catabolism, which in turn promotes glycerol production and NADH recycling. That glycerol levels do not significantly change in strains engineered with pCtAKR is consistent with this cycling hypothesis. The combined effects may promote the first two steps of xylose assimilation, which require NADPH and NAD$^+$, by helping to alleviate cofactor imbalance. Decreased acetate levels may also result from increased glycerol cycling, since acetate is otherwise generated as a fermentation byproduct to alleviate cofactor imbalance (Jeppsson et al. (2002) supra). While the precise mechanism will be the subject of future study, the ability to identify genes that improve xylose assimilation shows the promise of harnessing ecology and evolution through comparative genomics for biofuel research.

Example 4

Materials and Methods

Characterization of Engineered Scer Strains.

Ten Sp. *passalidarum* (Spas) and *C. tenuis* (Cten) genes were selected for characterization in *S. cerevisiae* (Seer) engineered with PsXYL123, using the following selection criteria. First, 109 OGGs that were induced in response to xylose in at least two of the three xylose-fermenting species (Spas, Cten, and *Pichia stipitis*, Psti), but were not induced in the non-xylose-utilizing species (*Candida albicans*, Calb; and *Lodderomyces elongisporus*, Lelo) were selected. Next, the coding sequence of the Spas and Cten genes in these OGGs was examined. The inventors required the genes to contain no CUG codons, enabling heterologous expression in Scer without the need for codon optimization. Second, genes that were most likely to be involved in some aspect of carbon metabolism based on predicted annotations and protein domain analysis were prioritized. This list included a Cten aldo-keto reductase (CtAKR), a Cten galactokinase (CtGalK), a Spas glucose-6-phosphate dehydrogenase (SpGPD), a Spas UDP-glucose-epimerase (SpUGE), a Spas glucose phosphate isomerase (SpGPI), RGT2 from Spas and Cten (SpRGT2 and CtRGT2), and YBR2 from Spas and Cten (SpYBR2 and CtYBR2). An additional three genes were included because they were also from the list of 43 OGGs present in xylose-fermenters but absent in non-xylose-utilizers: a Spas unannotated protein (SpNA), a Spas oxidoreductase (SpOR), and a Spas hexose transporter (SpHXT). Table 13 lists sequence identification numbers of the amino acid sequences for all genes in the 43 OGGs present in xylose-fermenting yeasts and not present in xylose non-utilizing yeasts.

TABLE 13

OGGs present in xylose-fermenting yeasts and not present in xylose non-utilizing yeasts.

| OGG Identifier | Gene name | SEQ ID NO: |
|---|---|---|
| OGG1116 | psti_3119 | SEQ ID NO: 4 |
|  | spas_5216 | SEQ ID NO: 5 |
|  | dhan_6676 | SEQ ID NO: 6 |
|  | cten_1875 | SEQ ID NO: 7 |
| OGG1217 | psti_4617 | SEQ ID NO: 8 |
|  | spas_2073 | SEQ ID NO: 9 |
|  | calb_3001 | SEQ ID NO: 10 |
|  | ctro_2862 | SEQ ID NO: 11 |
|  | pgui_2530 | SEQ ID NO: 12 |
|  | cten_1134 | SEQ ID NO: 13 |
|  | clus_3924 | SEQ ID NO: 14 |
| OGG131 | psti_5296 | SEQ ID NO: 15 |
|  | spas_5020 | SEQ ID NO: 16 |
|  | calb_4584 | SEQ ID NO: 17 |
|  | ctro_541 | SEQ ID NO: 18 |
|  | dhan_1245 | SEQ ID NO: 19 |
|  | cten_1109 | SEQ ID NO: 20 |
| OGG1331 | psti_457 | SEQ ID NO: 21 |
|  | spas_5222 | SEQ ID NO: 22 |

TABLE 13-continued

OGGs present in xylose-fermenting yeasts and not present in xylose non-utilizing yeasts.

| OGG Identifier | Gene name | SEQ ID NO: |
|---|---|---|
| | calb_345 | SEQ ID NO: 23 |
| | cten_3873 | SEQ ID NO: 24 |
| OGG1345 | psti_2317 | SEQ ID NO: 25 |
| | spas_2554 | SEQ ID NO: 26 |
| | calb_2334 | SEQ ID NO: 27 |
| | ctro_3876 | SEQ ID NO: 28 |
| | pgui_5128 | SEQ ID NO: 29 |
| | dhan_3716 | SEQ ID NO: 30 |
| | cten_1670 | SEQ ID NO: 31 |
| | clus_393 | SEQ ID NO: 32 |
| OGG1356 | psti_916 | SEQ ID NO: 33 |
| | spas_927 | SEQ ID NO: 34 |
| | calb_662 | SEQ ID NO: 35 |
| | ctro_3674 | SEQ ID NO: 36 |
| | pgui_4141 | SEQ ID NO: 37 |
| | dhan_4551 | SEQ ID NO: 38 |
| | cten_1705 | SEQ ID NO: 39 |
| | clus_5191 | SEQ ID NO: 40 |
| OGG1788 | psti_1952 | SEQ ID NO: 41 |
| | spas_972 | SEQ ID NO: 42 |
| | dhan_3721 | SEQ ID NO: 43 |
| | cten_521 | SEQ ID NO: 44 |
| OGG1917 | psti_362 | SEQ ID NO: 45 |
| | spas_4700 | SEQ ID NO: 46 |
| | calb_3492 | SEQ ID NO: 47 |
| | ctro_313 | SEQ ID NO: 48 |
| | pgui_4113 | SEQ ID NO: 49 |
| | dhan_5395 | SEQ ID NO: 50 |
| | cten_1794 | SEQ ID NO: 51 |
| OGG2028 | psti_1000 | SEQ ID NO: 52 |
| | spas_4204 | SEQ ID NO: 53 |
| | calb_1835 | SEQ ID NO: 54 |
| | ctro_1402 | SEQ ID NO: 55 |
| | ctro_5327 | SEQ ID NO: 56 |
| | pgui_84 | SEQ ID NO: 57 |
| | cten_1720 | SEQ ID NO: 58 |
| OGG2043 | psti_1555 | SEQ ID NO: 59 |
| | spas_4616 | SEQ ID NO: 60 |
| | cten_5376 | SEQ ID NO: 61 |
| OGG2393 | psti_4122 | SEQ ID NO: 62 |
| | spas_1629 | SEQ ID NO: 63 |
| | calb_2987 | SEQ ID NO: 64 |
| | ctro_1659 | SEQ ID NO: 65 |
| | dhan_1363 | SEQ ID NO: 66 |
| | cten_1274 | SEQ ID NO: 67 |
| | clus_3549 | SEQ ID NO: 68 |
| OGG2405 | psti_964 | SEQ ID NO: 69 |
| | spas_4106 | SEQ ID NO: 70 |
| | dhan_6438 | SEQ ID NO: 71 |
| | cten_2531 | SEQ ID NO: 72 |
| OGG2766 | psti_4984 | SEQ ID NO: 73 |
| OGG2825 | psti_2847 | SEQ ID NO: 74 |
| | spas_1364 | SEQ ID NO: 75 |
| | calb_2057 | SEQ ID NO: 76 |
| | ctro_785 | SEQ ID NO: 77 |
| | dhan_3590 | SEQ ID NO: 78 |
| | cten_410 | SEQ ID NO: 79 |
| OGG293 | psti_1745 | SEQ ID NO: 80 |
| | spas_5228 | SEQ ID NO: 81 |
| | dhan_2093 | SEQ ID NO: 82 |
| | cten_3662 | SEQ ID NO: 83 |
| OGG295 | psti_1847 | SEQ ID NO: 84 |
| | spas_4993 | SEQ ID NO: 85 |
| | pgui_5417 | SEQ ID NO: 86 |
| | dhan_6720 | SEQ ID NO: 87 |
| | cten_680 | SEQ ID NO: 88 |
| | clus_4882 | SEQ ID NO: 89 |
| OGG2954 | psti_690 | SEQ ID NO: 90 |
| | spas_589 | SEQ ID NO: 91 |
| | calb_1711 | SEQ ID NO: 92 |
| | ctro_3291 | SEQ ID NO: 93 |
| | pgui_1604 | SEQ ID NO: 94 |
| | dhan_4692 | SEQ ID NO: 95 |
| | cten_525 | SEQ ID NO: 96 |
| | clus_4587 | SEQ ID NO: 97 |
| OGG3073 | psti_3281 | SEQ ID NO: 98 |
| | spas_4859 | SEQ ID NO: 99 |
| | pgui_1465 | SEQ ID NO: 100 |
| | dhan_3962 | SEQ ID NO: 101 |
| | cten_3982 | SEQ ID NO: 102 |
| | clus_2205 | SEQ ID NO: 103 |
| OGG3219 | psti_5777 | SEQ ID NO: 104 |
| | spas_152 | SEQ ID NO: 105 |
| | calb_5726 | SEQ ID NO: 106 |
| | pgui_3359 | SEQ ID NO: 107 |
| | dhan_1013 | SEQ ID NO: 108 |
| | cten_5152 | SEQ ID NO: 109 |
| OGG3221 | psti_2703 | SEQ ID NO: 110 |
| | spas_3331 | SEQ ID NO: 111 |
| | calb_4305 | SEQ ID NO: 112 |
| | ctro_5254 | SEQ ID NO: 113 |
| | pgui_2243 | SEQ ID NO: 114 |
| | dhan_4141 | SEQ ID NO: 115 |
| | cten_249 | SEQ ID NO: 116 |
| | clus_1167 | SEQ ID NO: 117 |
| OGG3329 | psti_213 | SEQ ID NO: 118 |
| | spas_997 | SEQ ID NO: 119 |
| | calb_1644 | SEQ ID NO: 120 |
| | ctro_6117 | SEQ ID NO: 121 |
| | ctro_617 | SEQ ID NO: 122 |
| | pgui_2907 | SEQ ID NO: 123 |
| | dhan_2929 | SEQ ID NO: 124 |
| | cten_3801 | SEQ ID NO: 125 |
| | clus_3762 | SEQ ID NO: 126 |
| OGG3365 | psti_5231 | SEQ ID NO: 127 |
| | spas_4807 | SEQ ID NO: 128 |
| | dhan_3932 | SEQ ID NO: 129 |
| | cten_4097 | SEQ ID NO: 130 |
| OGG3376 | psti_3122 | SEQ ID NO: 131 |
| | spas_743 | SEQ ID NO: 132 |
| | calb_4686 | SEQ ID NO: 133 |
| | ctro_4870 | SEQ ID NO: 134 |
| | pgui_1659 | SEQ ID NO: 135 |
| | dhan_2607 | SEQ ID NO: 136 |
| | cten_5171 | SEQ ID NO: 137 |
| | clus_1582 | SEQ ID NO: 138 |
| OGG342 | psti_4269 | SEQ ID NO: 139 |
| | spas_3180 | SEQ ID NO: 140 |
| | calb_2843 | SEQ ID NO: 141 |
| | ctro_4811 | SEQ ID NO: 142 |
| | pgui_3963 | SEQ ID NO: 143 |
| | dhan_5481 | SEQ ID NO: 144 |
| | cten_5102 | SEQ ID NO: 145 |
| | clus_5867 | SEQ ID NO: 146 |
| OGG3442 | psti_5765 | SEQ ID NO: 147 |
| | spas_5392 | SEQ ID NO: 148 |
| | dhan_3450 | SEQ ID NO: 149 |
| | cten_1829 | SEQ ID NO: 150 |
| OGG3637 | psti_2848 | SEQ ID NO: 151 |
| | spas_96 | SEQ ID NO: 152 |
| | calb_4506 | SEQ ID NO: 153 |
| OGG3804 | psti_1010 | SEQ ID NO: 154 |
| | spas_1482 | SEQ ID NO: 155 |
| | calb_2269 | SEQ ID NO: 156 |
| | ctro_3690 | SEQ ID NO: 157 |
| | pgui_3780 | SEQ ID NO: 158 |
| | dhan_6210 | SEQ ID NO: 159 |
| | cten_4167 | SEQ ID NO: 160 |
| | clus_3816 | SEQ ID NO: 161 |
| OGG3977 | psti_990 | SEQ ID NO: 162 |
| | spas_2238 | SEQ ID NO: 163 |
| | calb_4999 | SEQ ID NO: 164 |
| | ctro_4751 | SEQ ID NO: 165 |
| | pgui_434 | SEQ ID NO: 166 |
| | dhan_2131 | SEQ ID NO: 167 |
| | cten_5296 | SEQ ID NO: 168 |
| | clus_2526 | SEQ ID NO: 169 |
| OGG4486 | psti_4154 | SEQ ID NO: 170 |
| | spas_3772 | SEQ ID NO: 171 |
| | calb_564 | SEQ ID NO: 172 |

TABLE 13-continued

OGGs present in xylose-fermenting yeasts and not present in xylose non-utilizing yeasts.

| OGG Identifier | Gene name | SEQ ID NO: |
|---|---|---|
| | ctro_1880 | SEQ ID NO: 173 |
| | dhan_4533 | SEQ ID NO: 174 |
| | cten_4265 | SEQ ID NO: 175 |
| OGG4572 | psti_2991 | SEQ ID NO: 176 |
| | spas_3945 | SEQ ID NO: 177 |
| | calb_6047 | SEQ ID NO: 178 |
| | ctro_1973 | SEQ ID NO: 179 |
| | pgui_5356 | SEQ ID NO: 180 |
| | cten_3432 | SEQ ID NO: 181 |
| OGG4574 | psti_2117 | SEQ ID NO: 182 |
| | spas_3756 | SEQ ID NO: 183 |
| | calb_2418 | SEQ ID NO: 184 |
| | ctro_547 | SEQ ID NO: 185 |
| | pgui_866 | SEQ ID NO: 186 |
| | dhan_3524 | SEQ ID NO: 187 |
| | cten_2237 | SEQ ID NO: 188 |
| | clus_836 | SEQ ID NO: 189 |
| OGG4749 | psti_655 | SEQ ID NO: 190 |
| | spas_4484 | SEQ ID NO: 191 |
| | calb_792 | SEQ ID NO: 192 |
| | ctro_1637 | SEQ ID NO: 193 |
| | pgui_5160 | SEQ ID NO: 194 |
| | dhan_2412 | SEQ ID NO: 195 |
| | cten_1057 | SEQ ID NO: 196 |
| OGG5052 | psti_5199 | SEQ ID NO: 197 |
| | spas_3703 | SEQ ID NO: 198 |
| | calb_1674 | SEQ ID NO: 199 |
| | ctro_3496 | SEQ ID NO: 200 |
| | pgui_3899 | SEQ ID NO: 201 |
| | dhan_3191 | SEQ ID NO: 202 |
| | cten_1516 | SEQ ID NO: 203 |
| | clus_5023 | SEQ ID NO: 204 |
| OGG5073 | psti_3587 | SEQ ID NO: 205 |
| | spas_3060 | SEQ ID NO: 206 |
| | calb_3820 | SEQ ID NO: 207 |
| | dhan_6459 | SEQ ID NO: 208 |
| | cten_3136 | SEQ ID NO: 209 |
| OGG5433 | calb_4297 | SEQ ID NO: 210 |
| | calb_6055 | SEQ ID NO: 211 |
| | clus_1227 | SEQ ID NO: 212 |
| | cten_2558 | SEQ ID NO: 213 |
| | ctro_342 | SEQ ID NO: 214 |
| | dhan_3994 | SEQ ID NO: 215 |
| | dhan_6019 | SEQ ID NO: 216 |
| | pgui_1208 | SEQ ID NO: 217 |
| | psti_2820 | SEQ ID NO: 218 |
| | spas_4573 | SEQ ID NO: 219 |
| OGG5534 | clus_3644 | SEQ ID NO: 220 |
| | cten_2815 | SEQ ID NO: 221 |
| | cten_840 | SEQ ID NO: 222 |
| | ctro_3650 | SEQ ID NO: 223 |
| | dhan_6294 | SEQ ID NO: 224 |
| | pgui_4895 | SEQ ID NO: 225 |
| | psti_2237 | SEQ ID NO: 226 |
| | psti_3910 | SEQ ID NO: 227 |
| | psti_5233 | SEQ ID NO: 228 |
| | spas_3201 | SEQ ID NO: 229 |
| OGG5585 | calb_212 | SEQ ID NO: 230 |
| | clus_5643 | SEQ ID NO: 231 |
| | cten_99 | SEQ ID NO: 232 |
| | ctro_3753 | SEQ ID NO: 233 |
| | dhan_6638 | SEQ ID NO: 234 |
| | pgui_1025 | SEQ ID NO: 235 |
| | pgui_958 | SEQ ID NO: 236 |
| | psti_2299 | SEQ ID NO: 237 |
| | spas_2050 | SEQ ID NO: 238 |
| OGG5595 | psti_2092 | SEQ ID NO: 239 |
| | spas_1789 | SEQ ID NO: 240 |
| | spas_2928 | SEQ ID NO: 241 |
| | spas_2942 | SEQ ID NO: 242 |
| | spas_300 | SEQ ID NO: 243 |
| | spas_3304 | SEQ ID NO: 244 |
| | spas_3434 | SEQ ID NO: 245 |
| | spas_3769 | SEQ ID NO: 246 |
| | spas_4194 | SEQ ID NO: 247 |
| | spas_4708 | SEQ ID NO: 248 |
| | calb_1177 | SEQ ID NO: 249 |
| | ctro_5179 | SEQ ID NO: 250 |
| | pgui_4319 | SEQ ID NO: 251 |
| | dhan_4996 | SEQ ID NO: 252 |
| | cten_3110 | SEQ ID NO: 253 |
| | clus_2407 | SEQ ID NO: 254 |
| OGG584 | psti_2475 | SEQ ID NO: 255 |
| | spas_3515 | SEQ ID NO: 256 |
| | calb_334 | SEQ ID NO: 257 |
| | ctro_4827 | SEQ ID NO: 258 |
| | pgui_5254 | SEQ ID NO: 259 |
| | dhan_2853 | SEQ ID NO: 260 |
| | cten_572 | SEQ ID NO: 261 |
| | clus_4766 | SEQ ID NO: 262 |
| OGG590 | psti_1739 | SEQ ID NO: 263 |
| | spas_1962 | SEQ ID NO: 264 |
| | pgui_768 | SEQ ID NO: 265 |
| | dhan_1007 | SEQ ID NO: 266 |
| | dhan_3080 | SEQ ID NO: 267 |
| | cten_4472 | SEQ ID NO: 268 |
| OGG70 | psti_2028 | SEQ ID NO: 269 |
| | spas_271 | SEQ ID NO: 270 |
| | calb_1979 | SEQ ID NO: 271 |
| | ctro_4818 | SEQ ID NO: 272 |
| | pgui_5901 | SEQ ID NO: 273 |
| | dhan_291 | SEQ ID NO: 274 |
| | cten_4843 | SEQ ID NO: 275 |
| OGG724 | psti_4427 | SEQ ID NO: 276 |
| | spas_4470 | SEQ ID NO: 277 |
| | cten_298 | SEQ ID NO: 278 |
| OGG784 | psti_562 | SEQ ID NO: 279 |
| | spas_2665 | SEQ ID NO: 280 |
| | calb_600 | SEQ ID NO: 281 |
| | ctro_1982 | SEQ ID NO: 282 |
| | pgui_1428 | SEQ ID NO: 283 |
| | cten_616 | SEQ ID NO: 284 |

Data Sources.

The complete genome sequences of twelve Ascomycete yeasts were obtained and downloaded from their respective online databases (Table 1).

Genome and EST Sequencing, Assembly and Annotation.

Spas and Cten were sequenced using Sanger (40 kb fosmid library) and 454 (standard and paired ended libraries) sequencing platforms. Newbler (Roche, v2.3) was used to produce hybrid 454/Sanger assemblies. Gaps were closed by gapResolution (www.jgi.doe.gov), PCR and fosmid clone primer walks, or editing in Consed (Gordon et al. Genome Res 8:195-202 (1998)). Illumina reads improved the final consensus quality with Polisher (Lapidus et al. POLISHER: An effective tool for using ultra short reads in microbial genome assembly and finishing. in AGBT (Marco Island, Fla.; (2008)). mRNA was purified using Absolutely mRNA™ purification kit (Stratagene) and reverse transcribed with SuperScriptIII using $dT_{15}VN_2$ primer. cDNA was synthesized with E. coli DNA Ligase, polymerase I, and RNaseH (Invitrogen), nebulized, and gel purified for fragment sizes between 500-800 bp. Fragments were end repaired, adaptor ligated, and made into single stranded DNA libraries using the GS FLX Titanium library kit. Single-stranded DNA libraries were amplified in bulk and sequenced using a 454 Genome Sequencer FLX. Reads from each EST library were filtered, screened, and assembled using Newbler. Both genomes were annotated using the JGI annotation pipeline, and can be accessed through the JGI Genome Portal (www.jgi.doe.gov/spathaspora[[/]] and www.jgi.doe.gov/tenuis[[/]]). Table 11 lists genome sequencing statistics.

Details of library construction and sequencing can be found in the main text and at the JGI website (www.jgi.doe.gov[[/]]). The 13.1 Mb assembly of Spas consists of 26 contigs arranged in eight scaffolds. The genome was sequenced to 43.77X coverage (1.78X of Sanger and 41.99X of 454). A total of 53 Sanger finishing reads were produced to close gaps, to resolve repetitive regions, and to raise the quality of the finished sequence. Assembly completeness was confirmed by mapping 8,089 out of 8,349 EST contigs (97%) with 90% identity and 85% coverage.

The Cten genome was sequenced to 26.9X coverage (1.13X of Sanger and 24.97X of 454). 15,126 Sanger, 439,285 standard, and 634,050 paired-end pyrosequencing reads were combined into a 10.6 Mb assembly consisting of 1065 contigs organized in 61 scaffolds representing eight chromosomes. Assembly completeness was confirmed by mapping 7,493 out of 8,230 EST contigs (91%) with 90% identity and 85% coverage.

For Spas, one EST library consisting of 1,050,790 initial sequence reads led to a set of 1,020,921 "good" reads assembled into 8,349 contigs. For Cten, one EST library consisting of 987,487 reads resulted in 964,346 "good" reads assembled into 8,230 contigs. As used herein, "good reads" refers to base qualities above a minimum threshold of Q>20. These ESTs and contigs were used in annotation of the corresponding genomes.

Genome Annotation.

Both genomes were annotated using JGI annotation pipeline, which takes multiple inputs (scaffolds, ESTs, and proteins) and runs several analytical tools for gene prediction and annotation, and deposits results to JGI Genome Portal (www.jgi.doe.gov/spathaspora[[/]] and www.jgi.doe.gov/tenuis[[/]]) for further analysis and manual curation.

Genomic assembly scaffolds were masked using Repeat-Masker www.repeatmasker.org[[/]]) and a standard Repeat-Masker library of 234 fungal transposable elements (Jurka et al. *Cytogenet Genome Res* 110:462-467 (2005)). tRNAs were predicted using tRNAscan-SE (Lowe & Eddy, *Nucleic Acids Res* 2:955-964 (1997)). Using repeat-masked assembly, several gene prediction programs were used: ab initio FGENESH (Salamov & Solovyev *Genome Res* 10:516-522 (2000); homology-based FGENESH+ and Genewise (Birney E & Durbin R *Genome Res* 10:547-548 (2000)) seeded by BLASTX alignments against GenBank's database of non-redundant proteins (NR; www.ncbi.nlm.nih.gov/BLAST [[/]]); and cDNA-based EST_map (www.softberry.com[[/]]) seeded by the EST contigs (Table 14).

TABLE 14

Genes predicted by automated annotation, classified by method.

| Method | Spas | Cten |
| --- | --- | --- |
| ab initio | 919 (15%) | 1185 (21%) |
| Seeded by proteins in NR | 2258 (38%) | 2984 (54%) |
| Seeded by EST isotig | 2806 (47%) | 1364 (25%) |
| Total Models | 5983 (100%) | 5533 (100%) |

NR, NCBI non-redundant protein set

Genewise models were completed using scaffold data to find start and stop codons. EST BLAT alignments (Kent, *Genome Res* 12:656-664 (2002)) were used to extend, verify, and complete the predicted gene models. The resulting set of models was then filtered for the "best" models, based on EST and homology support, to produce a non-redundant representative set. This representative set was subject to further analysis and manual curation. High (>90%) proportions of the models are complete with start and stop codons, consistent with ESTs, and supported by similarity with proteins from the NCBI non-redundant protein set (Table 15).

TABLE 15

Quality of and supporting evidence for genes.

| Number of gene models | Spas | Cten | Psti |
| --- | --- | --- | --- |
| with start and stop codons | 5524 (92%) | 5358 (97%) | 4991 (86%) |
| with EST support | 5832 (97%) | 5485 (99%) | ND |
| with NR support | 5715 (96%) | 5283 (95%) | ND |
| with Swiss-Prot support | 5297 (89%) | 4914 (89%) | 5156 (88%) |
| with Pfam domain | 4075 (68%) | 3921 (71%) | 3645 (62%) |
| with transmembrane domain | 1124 (19%) | 1063 (19%) | 1161 (20%) |
| in multi-gene family | 2921 (49%) | 2542 (46%) | 2880 (49%) |
| Total Models | 5983 (100%) | 5533 (100%) | 5841 (100%) |

NR, NCBI non-redundant protein set;
ND, no data

Analysis indicated that both species display the alternate codon decoding of CUG for serine rather than leucine. Therefore, all predicted gene models were translated using alternative translation table 12 (CUG->Ser) and functionally annotated using SignalP (Nielsen et al., *Protein Eng* 10:1-6 (1997)), TMHMM (Melén et al., *J Mol Biol* 327:735-744 (2003)), InterProScan (Zdobnov & Apweiler, *Bioinformatics* 17:847-848 (2001)), BLASTP (Altschul et al., *J Mol Biol* 215:403-410 (1990)) against NR, and hardware-accelerated double-affine Smith-Waterman alignments (deCypherSW; www.timelogic.com/decypher_sw) against Swiss-Prot www.expasy.org/sprot[[/]]), KEGG (Kanehisa et al. *Nucleic Acids Res* 36:D480-484 (2008)), and KOG (Koonin et al. *Genome Biol* 5:R7 (2004)). KEGG hits were used to map EC numbers www.expasy.org/enzyme[[/]]), and Interpro and Swiss-Prot hits were used to map GO terms (www.geneontology.org[[/]]; Table 16). Multi-gene families were predicted with the Markov clustering algorithm to cluster the proteins, using BLASTP alignment scores between proteins as a similarity metric (Enright et al., *Nucleic Acids Res* 30:1575-1584 (2002)). Manual curation of the automated annotations was performed using the web-based interactive editing tools of the JGI Genome Portal to assess predicted gene structures, assign gene functions, and report supporting evidence.

TABLE 16

Functional annotation of proteins.

| Number of proteins assigned | Spas | Cten | Psti |
| --- | --- | --- | --- |
| to a KOG | 4376 (73%) | 3989 (72%) | 4417 (76%) |
| a GO term | 3685 (62%) | 3465 (63%) | 3477 (60%) |
| an EC number | 1823 (31%) | 1572 (28%) | 1705 (29%) |

Numbers in parentheses indicate percentage of total proteins from that species.

Syntenic regions were identified as those containing at least three genes and with 50% of all genes in the region conserved and syntenic in each species. Single species expansions are defined as 3X gene counts in one species compared to two others.

Codon Usage Determination.

tRNA gene sequences were identified with the program tRNAscan-SE v1.21 (Lowe & Eddy, supra). A multiple alignment of the tRNA genes was produced using ClustalW v1.81 (Thompson et al., *Nucleic Acids Res* 22:4673-4680 (1994))

with the default settings (not shown). The alignment shows unambiguously that the tRNACAG from Spas and Cten are orthologous to the serine encoding tRNA from other CUG-utilizing species and display the known polymorphisms that converted the codon recognition of this tRNA (Ohama et al. *Nucleic Acids Res* 21:4039-4045 (1993); Santos & Tuite *Nucleic Acids Res* 23:1481-1486 (1995); Sugita & Nakase, *Syst Appl Microbiol* 22:79-86 (1999)).

CUG codon usage was examined by comparing Scer (as the reference), a well characterized species that uses CUG to encode leucine, to the other 13 species (queries) in our analysis using custom perl scripts. First, all CUG-containing genes within each of the thirteen query species were identified. If the CUG-containing gene had a one-to-one ortholog in Scer (as assigned by reciprocal smallest distance, RSD; 17), pairwise protein alignments of the two genes were generated with ClustalW v1.81 (Thompson et al, 1994, supra). The protein sequence of the query species was then converted back to the corresponding DNA sequence. For each CUG codon in the query sequence, we identified the corresponding orthologous amino acid from Scer and counted the total number of CUG codons aligned to either leucine or serine and report this value as a percentage of the total aligned CUG codons (FIG. 4B). A clear delineation was observed for the species known to decode CUG with leucine (*C. glabrata*, Cgla; *Kluyveromyces lactis*, Klac; *Yarrowia lipolytica*, Ylip; and *Schizosaccharomyces pombe*, Spom), and those known to decode CUG with serine.

Species Phylogeny.

The phylogeny of the fourteen Ascomycete species in the analysis was estimated using the protein sequences of 136 orthologs present in single copy in all species, identified using our ortholog assignment method described below. For each set of orthologous proteins, multiple alignments were produced using ClustalW v1.81 (Thompson et al, 1994, supra) with the default settings and identified conserved alignment blocks using Gblocks v0.19b (Castresana, *Mol Biol Evol* 17:540-552 (2000)). The final concatenated alignment used for phylogenetic reconstruction analysis consisted of 28,166 amino acid positions. ModelGenerator v0.85 (Keane et al, *BMC Evol Biol* 6:29 (2006)) was used to identify the optimum model of amino acid substitution (RtRev+G+F) for maximum likelihood phylogeny reconstruction. Phylogenies were constructed using the maximum likelihood method with the program RAxML v7.0.4 (Stamatakis, *Bioinformatics* 22:2688-2690 (2006)) and using the Bayesian method with the program MrBayes v3.1.2 (Huelsenbeck & Ronquist, *Bioinformatics* 17:754-755 (2001); Ronquist & Huelsenbeck, *Bioinformatics* 19:1572-1574 (2003)). For both methods, topology was constrained to require the outgrouping of Spom. RAxML was executed with 100 rapid bootstrap inferences followed by a slow ML search using the RtRev+G+F model of amino acid substitution. MrBayes was executed for 500,000 generations with a sample frequency of 10 and a burn-in of 1250 samples using the mixed model of amino acid substitution with a mixture of invariant and gamma distributed rates across sites. Both methods produced identical topologies; consequently, only the ML tree is shown in FIG. 2B.

Ortholog Assignment and Resolution.

Orthologous gene groups (OGGs) were created using a modified RSD (Wall et al, *Bioinformatics* 19:1710-1711 (2003)) and OrthoMCL (Li et al., *Genome Res* 13:2178-2189 (2003)) method. RSD parameters: significance threshold, 10-5; alignment threshold, 0.3. OrthoMCL parameters: significance threshold, 10-5; inflation parameter, 1.5. Pairwise one-to-one orthologs were assigned with the RSD method using four reference species: Scer, Psti, Calb, and Spom. These species were chosen for their complete and/or well-annotated genomes, and because they are representative of the Ascomycetes in our study. Pairwise OGGs (including orthologs and paralogs) were also assigned with the OrthoMCL method using the same four reference species. Results from the two methods were compared and combined using a custom perl script to maximize high confidence assignments (true positives) and minimize low confidence assignments (false positives).

In approximately 85% of comparisons, the ortholog assignments between RSD and OrthoMCL agreed perfectly. In cases when the two did not agree, the four reference genomes were used to resolve OGGs by comparing the different results from each reference, and determining a majority consensus when possible. Approximately 150 of the OGGs remain unresolved. Within the amino acid sequences of the genes in these OGGs, there is not sufficient phylogenetic information to determine if the OGG consists of genes derived from a single ancestral gene, or if there are multiple ancestral gene signatures in the OGG. These OGGs generally contain large families of genes with highly similar sequence (e.g. sugar transporters). The result of this analysis is a list of 12,038 OGGs containing the entire set of 81,907 genes. Over 90% (74,633) of the genes are contained within 5,749 multi-species OGGs (FIG. 5).

To avoid false negative calls of ortholog absence, a method implemented with custom perl scripts was devised. For each species not assigned a gene in a particular OGG, the complete genome sequence of that species was examined through multiple tBLASTn (Altschul et al. *Nucleic Acids Res* 25:3389-3402 (1997)) runs using the protein sequence of all other genes in the OGG as queries. Results were filtered to identify putative missed ortholog assignments (false negatives) attributed to incomplete or incorrect genome sequence or genome annotation. These putative new orthologs were assigned a 'flag' for possible orthology and are indicated in blue in all OGG figures.

OGGs were classified as multi-species or single-species (Table 3). Single species OGGs are comprised of expansions (a group of paralogous genes from a single species, which are likely to represent real genes) and orphans (genes with no recognizable homolog in our data set that may be annotation artifacts or novel genes.)

Evolutionary Analyses.

Bayesian gene trees were generated for each OGG using MrBayes v3.1.2 executed for 100,000 generations with a sample frequency of 10 and a burn-in of 250 samples using the mixed model of amino acid substitution with a mixture of invariant and gamma distributed rates across sites. Non-synonymous nucleotide substitutions (dN) and synonymous substitutions (dS) were estimated using PAML (Yang, *Mol Biol Evol* 24:1586-1591 (2007)) implemented with custom perl scripts and calculated average dN/dS over all lineages within the xylose-utilizers or the non-utilizers.

Fungal Strains and Growth Conditions.

Except for heterologous overexpression in Scer, all fungal strains used in this study are sequenced strains and are listed in Table 2. Heterologous overexpression of selected Spas or Cten genes was conducted in two different Scer strain backgrounds: BY4741 (S288c) or a wild diploid strain (GLBRCY2A). In both strains, a codon-optimized DNA cassette (DNA2.0, Inc.) containing the Psti XYL1, XYL2, and XYL3 genes (PsXYL123) was integrated at the HO locus in single copy utilizing known Scer promoters and terminators to drive expression. Negative control strains (BY4741-empty and GLBRCY1A) contain the integrated DNA cassette with Scer promoters and terminators but without additional heterologous genes. Individual Spas or Cten genes were cloned between the Scer TEF1 promoter and TUB1 terminator in a 2-micron pRS426 vector (Christianson et al., Gene 110:119-122 (1992)) modified with a Hygromycin selection marker and transformed into the above strains. All constructs were confirmed by diagnostic PCR.

Xylose Growth Assays.

For all xylose growth assays, cultures were grown in YPD (1% yeast extract, 2% peptone, 2% glucose) or synthetic complete (SC) media (1.7 g/L yeast nitrogen base, essential amino acids and 1 g/L ammonium sulfate or monosodium glutamate when mixed with Geneticin), with 2% glucose (SCD) at 30° C. for at least 16 h to early-mid log phase. For growth on solid media each culture was washed once in SC (no sugar), diluted to an OD600 of 0.3 and was spotted onto plates containing 2%-10% glucose or xylose. Growth was scored after three days at 30° C. For liquid growth assays with untransformed yeast species in FIG. 6, washed cultures were split and supplemented with glucose or xylose to a final concentration of 2% or 8% sugar. The OD600 of each culture was monitored for approximately 8 h at 30° C. For liquid growth assays with engineered Scer strains transformed with Cten and Spas genes (FIG. 12 and FIG. 13), mid-log phase cells grown in SCD with 200 µg/ml Hygromycin B were pelleted, washed once in SC (no sugar), and resuspended to an OD600 of 0.4. Then, 100 µl of cells were mixed in individual wells of a 96-well microplate containing 100 µl of media for a final concentration of 8% xylose or glucose and 200 µg/ml Hygromycin B. Microplates were then loaded into TECAN F500 or M1000 plate readers, which maintained cultures at 30° C., measured OD595 values every 5-10 minutes for 50 hrs and agitated plates at 200 rpm in BY4741 growth assays. Relative cell density was calculated by subtracting media only OD595 values and dividing by the inoculum background-subtracted cell density.

Xylose Fermentation.

For xylose fermentation measurements in untransformed yeast species (FIG. 8), cells were initially grown to saturation for 36 h in YPD (10 g/L yeast extract, 20 g/L peptone, 20 g/L glucose) at 30° C., washed once in SC (synthetic complete; 1.7 g/L yeast nitrogen base, essential amino acids, 1 g/L ammonium sulfate), and split into two cultures: SC+8% glucose and SC+8% xylose. Then, 50 mL of cells were resuspended in a 125-mL Erlenmeyer flask to an OD600 of 10 and were incubated at 30° C. in an orbital shaker at 100 rpm. Samples were taken every 8 h for 56 h. For xylose fermentation measurements in engineered Scer (FIG. 13, FIG. 15 and FIG. 16), 50 mL of cells were resuspended in YPXD (5 g/L yeast extract and 10 g/L tryptone, 58 g/L glucose, 28 g/L xylose) in an airlocked 125-mL Erlenmeyer flask to an OD600 of 2 and were incubated at 30° C. in an orbital shaker at 150 rpm. Samples were taken every 12-24 h for 168 h.

Concentrations of xylose were determined by biochemical assay using a Megazyme (Bray, Co. Wicklow, Ireland) D-Xylose Assay kit following the manufacturer's instructions. Concentrations of ethanol in untransformed yeast species were determined using an Agilent Technologies 7890A gas chromatograph with a 7693 autosampler and flame ionization detector (FID). The instrument was operated and data acquired using Agilent GC Chemstation version B.04.02. The GC Inlet was equipped with a 4 mm ID deactivated split liner with deactivated glass wool (Restek, Inc) and held at 250° C. throughout the run. The helium carrier gas flow through the column was maintained at 1 mL/min with electronic pressure control. A 1 µL sample was injected with a split ratio of 20:1. The GC column was a Stabilwax-DA 30 M×0.32 mm ID×0.5 µm stationary phase (Restek, Inc). The GC oven program was as follows: Initial temperature of 110° C. was held for 3.5 minutes after injection, increased at 60° C./min to 250° C. and held for 5 minutes. The oven was equilibrated at the starting temperature for 3 minutes between runs. The flame ionization detector parameters were: detector temperature 300° C., hydrogen (fuel gas) flow 30 mL/min, air flow 400 mL/min, nitrogen makeup gas flow 25 mL/min.

Microarray Hybridization.

The response of Psti, Spas, Cten, Calb, and *Lodderomyces elongisporus* (Lelo) to growth in 2% glucose (YPD) or 2% xylose (YPX) was characterized by species-specific microarray (Roche-NimbleGen, Madison, Wis.). Cells were grown for approximately 16 h in YPD at 30° C. to early-log phase. Cells were washed once in YP and split into two cultures: YPD or YPX. Cells were collected at OD600 0.5-0.6 after 3 generations growth. RNA collected from cells grown in each sugar was compared to a genomic DNA reference sample for that species. Three biological replicates were performed for each species.

Cell collection, lysis, and total RNA isolation were performed as previously described (Gasch, *Methods Enzymol.* 350:393-414 (2002)). Following total RNA isolation, RNA was further purified with LiCl and Qiagen RNeasy kit. Sample labeling was performed as previously described (Gasch 2002, supra) using cyanine dyes (Amersham), Superscript III (Invitrogen, Carlsbad, Calif.), and amino-allyl-dUTP (Ambion, Austin, Tex.). Species-specific, custom 375K microarrays (Roche-NimbleGen, Madison Wis.) were designed to tile the whole genome using the program chipD (Dufour et al. *Nucleic Acids Res.* 38 Suppl:W321-325 (2010)), which optimizes probe length and probe spacing to maximize probe isothermality. Arrays were hybridized in a NimbleGen hybridization system 12 (BioMicro), washed, and scanned using a scanning laser (GenePix 4000B, Molecular Devices). Hybridization, washing, and scanning were performed according to NimbleGen protocols www.nimblegen.com/products/lit/expression_userguide_v5p0.pdf). Statistics for each species-specific array are found in Table 17.

TABLE 17

Statistics for species-specific custom tiled microarrays.

| Species | Total Probes | Mean ± SD Probe Length (nt) | Mean ± SD Probe $T_m$ (° C.) | Median Probe Spacing (nt) |
|---|---|---|---|---|
| P. stipitis | 374100 | 53.6 ± 4.1 | 76.3 ± 2.1 | 33 |
| Sp. passalidarum | 362487 | 54.5 ± 4.0 | 75.2 ± 2.6 | 29 |
| C. tenuis | 363196 | 53.1 ± 3.8 | 76.8 ± 2.2 | 24 |
| C. albicans | 373067 | 55.2 ± 4.0 | 73.7 ± 3.0 | 31 |
| L. elongisporus | 371451 | 54.1 ± 4.1 | 75.0 ± 3.0 | 33 |

Median probe spacing is determined by measuring the distance between 5' ends of adjacent probes, which are located on opposite strands.

Statistics and Microarray Data Analysis.

Data normalization and statistical analyses were performed using Bioconductor Gentleman et al. *Genome Biol.* 5:R80 (2004)) and custom perl scripts. The affy( ) package (Gautier et al., *Bioinformatics* 20:307-315 (2004)) was used to apply probe-level quantile normalization to the log 2 signal of RNA versus the species-specific genomic DNA control. Gene-level expression changes were summarized with the median value of each probe set contained completely within each predicted ORF. Finally, the fold-change of expression was calculated as the mediancentered ratio of genomic DNA-normalized RNA signals for xylose versus glucose.

Genes with significant expression differences in response to xylose were identified separately for each species by performing paired t-tests using the Bioconductor package Limma v2.9.8 (Smyth, *Stat. Appl. Genet. Mol. Biol.* 3: Article 3 (2004)) with a false discovery rate (FDR) correction of 0.05 (Storey & Tibshirani, *Proc. Natl. Acad. Sci. USA* 100:9440-9445 (2003)). For cross-species comparisons, genes within orthologous gene sets (OGGs) were evaluated for expression differences. When an OGG contained more than one gene from a particular species, genes with the smallest phylogenetic distance (determined with PAML v4.3; Yang, *Mol. Biol. Evol.* 24:1586-1591 (2007)) were directly compared. Hierarchical clustering of gene expression across species was performed with Cluster 3.0 using the uncentered Pearson correlation as the distance metric (Eisen et al., *Proc. Natl. Acad. Sci. USA* 95, 14863-14868 (1998)).

Data Deposition:

The assemblies and annotations reported here have been deposited to Genbank under accession numbers AEIK00000000 (Spas) and AEIM00000000 (Cten). Microarray data have been deposited to the Gene Expression Omnibus www.ncbi.nlm.nih.gov/geo[[/]]) under accession number GSE24858.

As can be appreciated, the results described in the above examples support the utility of the nucleic acids, yeast strains and methods described and claimed herein for enhancing biofuel production in yeast.

Other embodiments and uses of the invention will be apparent to those skilled in the art from consideration from the specification and practice of the invention disclosed herein. All references cited herein for any reason, including all journal citations and U.S./foreign patents and patent applications, are specifically and entirely incorporated herein by reference. It is understood that the invention is not confined to the specific materials, methods, formulations, reaction/assay conditions, etc., herein illustrated and described, but embraces such modified forms thereof as come within the scope of the following claims.

SEQUENCE LISTING (284 sequences)

SEQ ID NO: 1 - DNA, 930 bp, Candida tenuis
atggttaaagctttcaaatctactaaggtctacaaattatcgaccggttcgtctatccccgcccttggtttgggcacttggagagcgactgatgaagaagtttacaactccgtcttaaccgctttgaaagctggttacagacatattgatactgctgctggttacggtaacgaagaaccaatcggtaaagctataaaagattctggaatttccagagatcagatatttgtcactacaaagttatggtcgactaagcactatgatcctgaatcggcattgaaagaatccctttctaagttgggtcttgaatatgttgacttatacttgatgcattggccattggctatgaacccaaatggtaatcacccagccattccaaccagaccagatggattaagagatattgtgtatgattggagctttactaagacctggaaattaatggaacctttggtggaacaaggattaactaaatcccttggtatttccaactgtactgtttctaaaatgaaggaattattcgattccggtttaaaggtcaaacccgtgtgtaaccaagttgaattgcacccatacttgccacaacataaattgttggaatttgccaaagaacatgatgtcgttcttgaagcttactccccattgggttccgccgacgctcctttgttaaaggatgaatctatcaaagccattgctgaaaagtatggtgtgtcttcagctacagtgattatttcttgggctatttggagaggaactgtcgttttgccaaaatctgttaaacctgaaagaattgaaagcaacctcgagatcattgagctcgaggataaagatggagaagccttgaacagaattgctgaaaatagagggggccctcaaagattcgtctctcctccttgggatcctgttgtcatctttgactcttctgaatag

SEQ ID NO: 2 - DNA, 735 bp, Spathaspora passalidarum
atgttcaagtcaatctttcaatcaatcaagccaatgatcattaacggtgctaccagatccggcgttacagttactgccacaccagctacttctattactatttatcacaatacaaactccttgttatcacacaatttgttatccaagttgtcttcatacagtgttttaccatgcactgttcacagatttaaggattctcatcaaaccatcacctcatacactactgacaaggtctcatcttcgaatggacaagcaccaattgccaaatttgatgtcgatgtcaagtttaaccaaggattatctaagacagattacgatttcattatgaatgaatgtgtcgatatccaccctgataatcaatccattatgttgcaattgttgtatggggttagccatgacaagagaaagttgatcaagtcttttgatttacacgacgaattgtacagtaactttgatagagtctcacaattatcaagagaaaatggtcctttgattattgactacaacaacaagttgattgccaacgatgaagcttcatttgatcgtatcatggttaattacttgagttgtggaattcaaaatgttgataaggctggtgctggtttaggttcaaatggttctagcaacaatagcgccaatcttaacgtgtctgctgctagtactattccagccgctgagttgtaccatcaaaatttaatccatcctcacgttgctgagtttgctgatttgttttaa

SEQ ID NO: 3 - DNA, 1731 bp, Spathaspora passalidarum
atgcacggaggttcagacggtaatgacgttcaagctatcattgctcaaaagcgtttagaaattgcaggtaagccaggtattgctggtttaattgccaacagaaaatctttccttattgcagtttttgcatccctcggtggtttagtctacggttataaccaaggtatgtttggtcaaatttctggtatgacctctttctcagcagctgctggtgtcggtaagattcaagataatccaactttgcaaggtttattgacctctattttagaattgggtgcttgggtcggtgtgttaatgaacggttacgtcgccgatagagtcggtagaagatggtctgttatgtttggtgttgcttggtttattctcggtgttattattcaagcttgtactcacggtgctaactattcattcattcttggtggtagattcattgtcggtgtcggtgtcggtattctttctatgattgtcccattatataacgctgaagttgctccaccagaaattagaggttccttagttgctttacaacaattggctattactttcggtattatgatttcttattggattacctatggtactaacttcattggtggtactggtgaaggtcaaagtaaggctgcttggttagttccaatttgtattcaaatggttccagctttaatcttgggttcttgtatcttccttatgccagaatccccaagatggttaatgaacgaaggtaacgaagaaaagtgtttggatgtcctttccagattacgtggcttagacagaaacaacgaattgattcaaatggagttccttgaaatgaaggctcaaaagattttcgaacatgaattagaagccactgcttacccagacttacaagatggttctgcttcttctagattcaagattggtttccttcaatacaagtctatgcttactcactacccaactttcaagagagttgctgttgcttgtttgattatgactttccaacaatggactggtgttaactttattttgtactatgctccatttattttcgcttccttaggtttatctggtaagaccacttccttattggcttctggtgttgttggtatcgtcatgttccttgccactattccagctgtcttgtgggtcgatcaattgggtagaaagccagtcttgatttctggtgctttacttatgggtatgtgtcatttcgttgttgctggtatcttgggtggtcttcacggtgatttcaccaacaacatgggtgctggttgggctgccgttgtctttatttggttattcgccatcttcttcggttactcttggggtccatgtgcctgggttattgttgctgaagttttcccattaggtttaagagccaagggtgtttccattggtgcttcttctaactggttaaataacttcgctgtggccatgtctactccagatttcgttgccaaggctacttacggtgcttatatcttcttaggattgatgtgtgtctttggtgctgcttacgttttcttcttctgtccagaaaccaagggtagaactttggatgaaatcgatgaattattcggtgatacttctggtgtttccaagagagaaggtgaaatccgtaaccgtattcttaaggaagttggtttattggaattaattggcttagaagaattagactctgacaagtctaagggtggtgatgttcattaccaagaagaaaaggccgctgatgctgatgctgacagtgcttaa

SEQ ID NO: 4 - protein, 58 aa, Pichia stipitis
MAGHIAKYLRHAPVAKPHVDLKIKWASKLLGGTMWFYIFYRIKEDGPVMFGQKLPFEH

SEQ ID NO: 5 - protein, 60 aa, Spathaspora passalidarum
MAAGHFVKYVRHAGAAAPHVSPAIRWTAKLSGAAMWFWILYRVKEDGPVMFGWKLPHEHH

SEQ ID NO: 6 - protein, 59 aa, Debaryomyces hansenii
MAGHAAKYIRHAAASAPHVDPRLKWTSKLLGATMWFVIMYRVKEDGPVMFGQKLPFENH

SEQ ID NO: 7 - protein, 60 aa, Candida tenuis
MAGHGHAYVKHGAVAVPHTDPRLKWGAKLLSATMWFYIFYRVKQDGPVMFGQKLPFEHHH

SEQ ID NO: 8 - protein, 639 aa, Pichia stipitis
MTWTKRDFLDLSADSTFGSTAFNLGKDPLLHQLEQVREYSEQDLLANMIYIFLLLVFATVVLGAVSFGVREYYLSMKSKLDTATSPFTPQAEDEIWNARNDQIQTTPALPESNAPSSNLKQLPMESEESQNRLSENSLASGFTHFTENRVQLQKNHTIEETESSNQGLSGSLEQVTELEKIQIFRDDIESPGLKHFMSADISKGENLLSEKDSPQEPLPPPPPPPTRVRTKSKTNKKTTYSISHLLSLNSDILTKYLTHRLKSRSIKMSKILRYSADIPATEFETAWNANKSVNDARAKLEMNEAGDSDFETDSDAGSDYGDKNKCTGCIAVLQLLSIGVSDPILGNPNYFLPAFNDLIEHLIDTGQVFQVLVYSVRSHSQLLLLEMMLIYCWSHWNYRSNDSSAIQRQFQKWNLVEPVVRSRDTIFRYLCNLQLGLAANYTEISLSSTPSFINEGEFRIHLLLREAVKSFCNDYMQFIPMIAQAVDVAQLHNTKVLFYDLLHVLLQKHSQCCMAEYLLEDNTDLKALVQHGLWHKHNHRLHKYSYRILHFLLEQGDHNLVELWERQVEGGKLYVPSAGVVANATVSANSPQQLLGINMYATALQKPITPGGLSYGLLSGLVYGTQRHSSMRRKLAREL

SEQ ID NO: 9 - protein, 617 aa, Spathaspora passalidarum
MTLHEPTLEQINHPKHNRKHSKFHQEPYYILDNHMDSYLKLAGNSIDTCVLLTNAFYIFLTLILVVVIAGAITFGVREYYLSFKNKVTSSTSEVIKLCNWNDKEQPSNDESAVQDTSADQPKSDDDDGGGRGGGGGGGGGVGVGGAGGGPSTGTSPHIESGMTQFEDNKTNNENSQWEFNKFEPSSSIALSSGNNRLHVIMNNSSGFSDKSITKFLNKNLPTSTPKIVYSFKQLQNLNIKTNNLFGGTKRKQKIPMTKLLSCNITIPRMTFDQAWKATRTISEAKVTVLNSTEDNVEKSLALLRILAVGQSHNELLDNPNVYLEVFNDCIEEFVDNGRIFTIFSDCNASLQRLLMEMLLSYCWCHYRYYEYPEKRKIIELHFQKWDLNYPPVIQTRCTIFRLLCNLQLGMFTVLYESQEVCGENDLKLGLVIRELAKHSLCNDFIGFIPMLAQAIDVTNLERNRCFFYEILKVLVAKHQKCCIPEYLQDTTIAELKALIQFGLHRDQPSAAISAKCDEILNFLVQQDKKVATWKTEVATTNVSSPIAQSSGYGEKFFTAPLYKLHQSAVPLHTQAPLPVPQPAHTQSGSVPTSNSWNFGVVSNANFIDSGGDIQSGE

SEQ ID NO: 10 - protein, 638 aa, Candida albicans
MIEPQDLQRKVNLFKRSPQKPIYKQNLLMDHEEPQYIIDNYKNSYLKIGGNGDGLDNSGNTNIMPLAANAKSIPMSTDTDSLILANAFYIFMTIIVLLILLSSISFGIREYSFAFRRRIKSSTNEALKLNNWNNTNKKANRPSPLCNKIDKAQVREATNTETNNQHETPMSSKNNAISGMTQFTDKEPKIENAQQWCYKEDTSPNYNVPSSHTESEKVYYENEYDSGLTDKSITKFTKKQTIPSFVTIQPKSIYSIDSLMALDKTKAMIGGVLNNVFKYKQKQKIPMSCLLNCTIVLPRTTFDNAWKAAKVIRDAENEIITSSCKISKKLSLLRILSIGKSFELLDNPNIFLEAFNDCIENLVDMGLVFTMMFDSSVVLKLLLIESLLTYSWSHYRFYDFDAKSNLVKLQFSNWNLPHPIVQTRNTIFKILCNLQLGLDTIFAESKEMENDNELKLGLVIRESINHSVCNDYIGYVPMIAQAIDISNIDRNKFFFYEILKLLIVKHGNCCMKEYIQESNIELKTLVQYGLSDDQHLVIQDKAKEIFQLLSRHDENIFMWFNDINHSKIHIDSAVPLSTEHTEKYFSAPLFKQQPPILEEPSSGSTFDSFSHSWKMGILSSDLKFHKNIDNRQSRVVDF

SEQ ID NO: 11 - protein, 703 aa, Candida tropicalis
MIEPRDIKEKIQLFRHSPQQPIYRQNLLMSHEEPEYIINNHKDSYLKLGNAHIADTDLGGNTHYDEAFYPLSANIQSLPVELDNPILANGFYYFMTIIVVLILVSAISFGVREYSFAFRRRIKSSTSEAIKLTNWNDIKGAITSTTETTNNINSIRQKIMNRIKEEENNDRSRVGVDGSGDDQADLGIDIRVGKAGGGTDRPIMILQNNSAPIHHVSDSSSKNNMESGFTQFMEKGQHNDTTEWECERFQSAELNEETLTKSEGKDCYGNDYNTGITEKSISKFARQQSLKLPHPPLKPVYSIGFLKGIDKSTTPISEVLINISKFKQKKKIPMSSLLSCSVGFPRTCFDNAWQASKVIREAESIILTTTCKVSRLLSLVQLLSVGKSIELLDNPNIFLEAFNDCIENLVDMGYVFNFFSESSVVLKLLLMENLLTYSWSHYRFHDLENKSRIIRVQFEKWNLPHPIVQTRNTIFKILCNLQLGLNTSCISTTTEQAEIENGLKLGLVIREVINHSVCNDYIGYMPMIAQAIDISTVDRNKFFFYEILKLLIVKHGKCCMGEYIQESNIELKTLVQFGMTTNQIPIINDKVKEILEMLIKIDGKIISWKNMTATNNNYIASAIPLSTEHTENYFSAPLFRQPQKQQDHLEKQPNRLPLLDSGSTSGSTLETFANSWKLGVVSSDINYSQETIENQHQYHYNRG

SEQ ID NO: 12 - protein, 438 aa, Pichia guilliermondii
MNFTVASHEAEILGQAGIIYAMLLGGTAIIGGISFGIRQLTLKESPDTKTTSFAAKDMADGIELKTIESGESESQNSSKSSPESELGKTDVIRLLDSGNTLQRSPIRLSPISNCWTASGPISLRYDEIPWSPIPQRNNWLKDLYDVQKSMAQDTLALKEDLQALKSIKLSQCVYPSVVIPPIRFLSVWRANQAVEETKELLLDPSVDKCTKTIGLVRLSGLAAAKAFSLAVNPFSLYSFQALIEQLVDTGLVFQIIAQSPQPKYSMLLVVDIVASYSWHVWNDARSKAAAYGGARVMVIRTFCNLLLGLDGETTPQFVQVKLSILLEKMISTTRCHEYLTVVPMVAQAINIAVGGRTKTVFYDALFVIVVKHRQCCLEDEYLQQNTVLQQVISDGLASHSPKEREKALKLSQEVSGQVMVFAANAAADTSDLSHASAG

SEQ ID NO: 13 - protein, 446 aa, Candida tenuis
MSAKDRAGSISSQKAARANWSENQDARKRGDSYPEDEKDLEALGSLNRIVAEPIVAPSMSLSQSSQSTTESVSASEFVEEIEEFKRIRIIYDEVNSSETKSISEYLHQPLRNNKIVYSMKDLHDIQMEMEREFKQSDNLSKSKVIKLSKVLSFRSIIPKTETPSVFLNNKSINKIKYDLVDSKGLDLASKMLSLFQFVSMGVNDNNNNYFLNSFNELVEYVTDTGILFELLEKITSPSLKELMVDMILNYCWKHWNQHGEANGKVIQSRTIIFRILCNLKIGVSSIESWGPSRSRNRIEFKVQTIMREITKRAKCNDYLELIPMISQAVEIIEAVSLKFIFYDMLLIILKSHHKCCMHDYLLDTHTDLKEVVQHGFWYKHERKLVAKTQEIFDFLVAVNGQIYSWYTEILQGRIYVSSASGVGPLMRDIPSEYKPTPPGGWKFVRK

SEQ ID NO: 14 - protein, 477 aa, Candida lusitaniae
METVSDTELSNAFFIFIVLIFSTATAALVSRRIKHFIMTTFQVQRLSETKCDHINAPTKQHNMAERLEAILQLEQSDGFASSMTTLGRSLQKTNPRSRVFSSLDLALVSSDESKKPTSHVKENIDAFETPKHRYLESELRRLCQPQNATSLPDQLDLPRLLKFENQLPPPQFDTTKVARMVIEELRISLLDKEDTSRALAFFQLAAIGSSQSVFDNPIYYHETFCNLLEDQVENHSLFKHSSSVDGLQMLLIDLLVCFTWCHWNYEDFFNLKGSERFPSQIENDNYPYPAQKMLEYFRRSASEPFVMSHLSVFRLLCSVWLESSFLLPLASLKLSLVFRTCAQQTGCYEHRQLLPLIEQSILAAENPSVKPFFYDLVAEIIEPHVDCCIDTHDVFYPHSHLQGLILQGMWIGQSSEIRAKANHVAHILGRAYPEVKLWTEPCEARTSNTQHMHDYSNTPGSSDKVIYWMDETREKSL

SEQ ID NO: 15 - protein, 342 aa, Pichia stipitis
MFKYLFGSNEDLTTPLTNEPTIDYNNTIHTIASERNRLSASRFNTESRSNSNYVLDYSDDELDSEEELTRDFQRILRNLTRSTESIRDWDLPTNHSLPTNYPGKFPKSTRTQEAQVSNGAHKGAGTYGDHVSRTYEPLSDRVPSADYLENFIEKSDTTEQIAKLEQEINEELRSSRKRTKTDGIQLDSVILKVKQQNQFLLNLNELIDINNNDQEIDNIPSSILRKYQALKEAYIKELNNSQIFYKGYYKLIGKYRQLKNAGNGVRSSAPDVNTSKSGFFIKEKVRLIKSSTKEENIKLICVNILRELDAMEDKDKTIAKYKQDLDAANERIRQLELQAQSK

SEQ ID NO: 16 - protein, 359 aa, Spathaspora passalidarum
MIKYLFGVGEDDSRPLVDEPTIDYNETIHSSTPSSQGNLRQTRKSILKDTTGSSHNNPDIPVIGDLSDSELDYDDDLIHDINLVREVTQTLSSGYDGLGNHATRISIPDDYPGKYPRSRERTSNLSEQKNDPNWDIRASKGGRTSNYSKSYESTEQVYESTIDRKLDQLRIEVDNELKNYKNKPSTGNDDTTSQLRELNTRLKARTQYLSKLSQLTKAYNEEQNESTIVPPDIMEKYDNMKTEYLEELHRTQTLYLAYYRLLEKHLQFRKTKSTKNDVTVSKSATKSVIPMREKIKLIQSKTSDSTIKNLCGNVLSDVNKWEQDRDSLLKEKEQLQKDLRQMKSEKEALQLKLNNKESK

SEQ ID NO: 17 - protein, 372 aa, Candida albicans
MWRSLLGLDNDDSELINQPTIDYNTISSPSKQPQQPKQNSQKNKPLDKPRNQTFGTVIDYSDIEDGDDDDEYPDLDDDIKTNTRLINQWKTNNIQPTTFNPTINQNGSINRQPTLTNVSLPDQYPGKFPHLKNDNDVKQDNSVNLLEADKEYESLIDAKIQALQREIDNNDNDNDNDNFPQNVETTNVLDEINNLQLKITSQTKTLQELNELVDVYEDEIQSNNTTTTTTTTPIPTTGKLIIDYKDYQNLKNEYMNELNRVKKLYEAYYLLFNRYISLKRSYKQQKEQKVASSKKNDVGKVDKVDEVDEVDEVDEVDEDDKDDKDPKDGRNGDTISIKEKINQIKSKTNDSSIKTICDTLLKDVTKLEKNWY

SEQ ID NO: 18 - protein, 298 aa, Candida tropicalis
MWKSLFGWDNDDSKLVNQPTIDYNITSTRTTKQNRNNNIKTIPKTYGTVIDYTSDDDDEAENELDRDIRYNTNMINEWSSNIKPINENLTLPNEYPGKFPNRPHSAPTITKTEPIRNYKIDKKLEALQREIDAEIESDKNSNIVQNINKLHSRILQQTSVLSNLNDLVDIYQDNEEMLNFSNDEKYNQLKKDYLVELNRVSKLYEAYYLLFNRYLELKRLNKKNNKGKTSAVPVKEKLKLIKSKTTDVSIKNICENVINDVKKMEIDFENQKNQLIEKHDFEVEELKKRIEELESGLK

SEQ ID NO: 19 - protein, 398 aa, Debaryomyces hansenii
MDITTILTKKRYISMETPKKGIISKALSSIFGATSPLANEPTVDYNNTIQTYPRYNEDTISTQALQRPYRSQNAEIIDNYDRQDTHDFLDKRGRLSRDSQYKDLFSDHYIIDSQVLDDSDDELNSDIDYIFNRYNHTNDVVNNLPERVPTSLPTNILNKETPGLRTGTQKRLPTDYPGRYPSPLALKRESFERKYVGSIDNDMRNLEREINLENDITTAQLNAKYNKYTPTYADRMYKGPGDDDRMATKNDKRLREIVDRVSDRNKFLNELNAYVDLNDQVEVPTDINEKYKALREEYIKELTNCQNFYKAYYKLVFKYRNLKKRISRSSTTTIREKINLIKSTSHQLSIRIICDNLLTELDKNDKTIAHYQNELAIANSKIKHLEDRLAERGPASNR

SEQ ID NO: 20 - protein, 423 aa, Candida tenuis
MVTSKNMFGRAFDGLFGPSSPLTNEPTIDYNNTIHSFRSQNTSYPRSPASSTNQYPTANYWEDSDEELNNDMSAVYNQLSENSTHISEYLHQASEIPGNFSTYSNEPVPNNAQMSFGPMTSRFENIGKDIVGDRFERIPKSSIFRSSSPNITRHKPSSLDTGLDARYNARRNGRTSTPTHYRSQRDLSVSRDELSTLDRFNSRGPKNDYQSEANIRPNSFKTRKPDENIGTSYSAYDKPFSSYESGDRFNRPRVDNLRDSISRFAKKDFKIFNDSKQEQAKELLKLEQEINQESLTKLNTKFNHTNIKLDQFKTLKSLNDQIVENNRVLSKFDELLKINNDPELRIPDKDNERYNNLRSEYLSELTNHQVFYQNYLKLFQKYKNLKSDKYAKVIAKLELIRDTTEENSIKLICTNLLNDFSKK

SEQ ID NO: 21 - protein, 162 aa, Pichia stipitis
MSEAQKFEQANVHYADQFTKGDLALPPARKVAVVICMDARIDPAKALGLSEGDAHVIRNAGGRASDALRSVIISQRLLGTREIVVVHHTDCGMLTFSDEQLRGIVKKETGHSVDHFAFLPFSDLEGSVKEDVEFLKNSPLVLDVPVSGYVYDVKTGKVKKVA

SEQ ID NO: 22 - protein, 161 aa, Spathaspora passalidarum
MTVASEFEQANKSYVDQFTKGSLPLPPARKVAVVVCMDARIDPAAALGLTEGDAHVIRNAGGRATDALRSVIISQRLLGTREIVVIHHTDCGMLTFTDEGLRKIVEDETGQNVDHFAFLPFNDLEKSVKDDVEFFKKNPLVLDVPVTGYIYDVKTGKITQV

SEQ ID NO: 23 - protein, 163 aa, Candida albicans
MSVAQEFEKANTHYSSNFTKGDLPLPPARKVAVVICMDARIDPAASLGLTEGDAHVIRNAGGRASDALRSVIISQRLLGTREIVVVHHTDCGMLTFSDNDLRGIIAKETGHNVDHFAFLPFGDLEKSVKDDVEFFKRNPLVLDVPVTGYIYDVKSGAINKVDS

SEQ ID NO: 24 - protein, 162 aa, Candida tenuis
MTVAKEFEKSNQKYVDQFAKGDLALPPSRKVAVVICMDARIDPAKALGLEEGDAHVIRNAGGRATDALRSVIISQRLLGTREIVVIHHTDCGMLTFTDESLRKQLVSEADENVDHFAFLPFNDLEKSVVDDVKFFKKNSLVLDVPVSGYVYDVKTGAINKVI

SEQ ID NO: 25 - protein, 252 aa, Pichia stipitis
RKRKITFLDEFKIVDPSTLTMETSKKRVPGKLIDRLWEPLDPQTLDSIDRLLNIALTMTIERYGNTAETQKVIAKTWLNVLDSKSFRSRLEVTKVPAPSSMATNKSNEISDILSYDQLSRRKTFLETYLNAELKQLLDLQKHYQGMEVAYQLDLEYLEEFRKTTASHAKDVNKDITNIRESLGLDARNGSSDNIKLTSKTDTKSLFNPDEDDATKELLQSLHSHLQSISSNTEQLGSLNDKLELVYNILDML

SEQ ID NO: 26 - protein, 318 aa, Spathaspora passalidarum
MDLEDTPIEEESREQPTEGKENRPTEQPEAPPHNRQSDKTGEANKQQESDQESPNEPPRKKRNIDVDKLTIIDPSEFKMSNNTKRITGKFIDKFWQPLDDVNAKSFDNILNLALSKTLERLGSLDSEGNMNEKMKLANKILTNAWLNPSNLESFKSRLRVTKVPLPSTMFPNNKGTIKDVFNYDKVLERKQFLETCLSAELKQLQDLEKYYHETKMIYESDKKYLSELTRATNGKEAKLRHQMYTQREELGLDEEIKPDVDLNLATSGTSSSSFNPDKDEEIKPILESLQKHLETISANTEPMLVFNEELEMLLNMLS

SEQ ID NO: 27 - protein, 252 aa, Candida albicans
MTDDSATPASKKRKLTFDNEILNPLNFQPMINKQKISTAVIEKFWQPLDSVNSQSMDNIMNVALLKTLDESHSKVSRSITNVWFNSANPESFKSRLSQTKLPPPSSMYSSKLRIRANEVADVLSYDSLKRKRTVLETYLSAELKQLQELENHYNQSLLAYKSDLEYLKKFKSTVKNNESKYNEELERKREELNLSVQNKNPDDIYLLSTDNDFDPETDDDTKFILETIQENLFQSKLKNLNDKLEVLCNVLD

SEQ ID NO: 28 - protein, 275 aa, Candida tropicalis
MAGSSPTEISDIPLENSHIDITNDEPSLKKRKLPFDNEALIPLNLQNIISKQRISTKIIEKLWQPLDVHNSQSMDSLLNIALLKTLEEESDVSKASRTLTTAWINQSNPESFKARLDQTNLPPPNSMYNTKVRIKANEIKDVLSYDSVSRKKTALETYLSAELKQLQELEDHYNQMLLSHQSDLQYLQKFKQTSKRHQLKLDSDIDDIHEELNLIEYDKKPDDIYLQSNSTYEFDPDQDEDTRAILEQLNKSLNISTSDLKKLNGKLEILSSMLD

SEQ ID NO: 29 - protein, 307 aa, Pichia guilliermondii
MSDRDGTDNINSPNRSPQSPALPDTPHSPPSPSHSSRTKSPENHESIEEPNEAKTSQIGLPTNFTLQTVRKRVPGKLVDRFWAPLDPETFNSLERIISVCSSKAVERYRRDQKKTQFNKKMASAQEIVANSWADRNNKSSFLSRLKVTKVPLPTSHSKRNSSEDMNVLAFDSLNRRKKFLETYLQAELKQVNQLEKYHKELSTVYQQDLQYLQEFKKTTEIEIKSMTEEATELRRNMGLENSKNTPEGEYVEKPVKPFNPNDDPETRQLLTEIRDKLAPLQEKCKELAEADDALDVLYNFLDIEAEE

SEQ ID NO: 30 - protein, 506 aa, Debaryomyces hansenii
MDRSTLDGSHEDSVTNSPSEKMSTVGNLEREDSTGHNFSSKENIGPNDEVDKVNTDDDARIYTETLGTKEEIMNYSSGLEVANKDEETPNISKENLVVSSEDASTNMNKGTTVGSAENEDSASIESETKITEIGTDQNNEIDTQVDSEVDAINNDELPQSLSNVDEGRIEKEASIDSVEDLKKTLSSRNSIVENSVNKESDQSDVSDNLQEDGLLLTNNKSNNTSPEGNTIPEINDYRIPNKPTKRKRDEILTNYEPIDPTSFQTEKNKKRVTGKFIDKFWEPLDAQTTSSLEKILNMCVNRTIEKYKGGSIVSKKMIEAQHLLSKNWLNEVNRKSFRSRLNVTNVPLPSTMQSTSKSIDNSLDILDYDQLTRRTQFLETYLLAELKQLSDLETYYSDLEMIYNLDLNYLNEFKKTTEINKSKMIKETIMKREKLSLDNIEPDRENIRLADHSVLTNSNFDPNSDNDTQDVLQLIDKQLQSLSSDTTNLTTLNEKLETLYNFLNKC

SEQ ID NO: 31 - protein, 322 aa, Candida tenuis
MSEPGASTSPNAHVDIPRGSSDLQDQVLPSTVSGYVGDQVSDPSAEIDKHQQSHIPNEDQSSEEPTALSSSSISSFYGSNKRRIEYTPFDPESLRSETHKKRVPGKFIDRFWEPLDETTAEEFDKILDICLNKAIERYKVVGDLLAHTWTSDHETSFKRRLQTTKLPRRVSIHSTNPQNDENKYVLNHDILNRRKTFLETYLSAELKQLKDLTKTYNKIELNYKSDLEYLKEFNKTVEANESKMSQEVYTKKTTMNLKYSDTSNLDSDVTSSNVRFTPREDDEVNELLEKLDSGLKRVSGNSKDLIDFHERLQNFQDSLDML

SEQ ID NO: 32 - protein, 361 aa, Candida lusitaniae
MDTSESTNKDAKDPSPAESLQSDRLPENTEPSASRPNTESPYTSASPFTETSISRGQTPDASDFYASDDSYSDSRQTPDASDDEANKRQGNLLAVERATKRSRTDSDDYDPQNPAGVRKEKVRKRVAGKVIEKLWSVLDRDSFKSFENLCDMSSNKVLERYGTSPAQRPKVMEAQRILANHWISERNPRSFLARLSVTKLPPLKSLHVRMKGSETVNYDPLSIDSVLHKKAMCEAYLSAELKQLESLESNFRALQSTYESDSKYLHDFKKTTSSLQAQNAAEKSEKMKQLHLDGIPSLTKNVHLEAQPQSGSLSGFSPNKDEEVSLLLQNINKIIDDKREPMRQMLESCDQLDVISSKLNS

SEQ ID NO: 33 - protein, 583 aa, Pichia stipitis
MSDDTDILDLRSGLNSLYMIYCTSLLPLVIIGIAFFYSGLTQRRSSLTMFAIPFLISPLIFIDWFIWGYSLCYAKASNKFIGSMEFVVLRHLKDSLLTVYANTRGEIFALNHFLFNGLFKVICAALTFPGCIAERGRMLPMLVFLFFWSCMIYNPVTYWFWNPNGWLSVDLNKLPVLDFAGGNCIHIVSGFTSLAYSYILGPRNPKILYNYRNINTGHIIFGTFLVMCGWVGFVGGCDFKFSPYSLFIFVNTILCACVGGIVWMLIDYYYSSIPLEGTQDSDNQDEQQQNRHVDSSARLSPLTSHLSNVAPVISETGVLLNQHLRETKSNFVERRKFSMISFSSGIMTGLVVITPGGGYVSSPNEFWKSIVYGVVGAICCNLSTRLKYFFHIDDALDIFAIHGVAGFVGSILTGIFANKQFNSDGGWVVGHWKQVGYQLLGSVVTASYVFIMTYFFLYIIDLVPGLHLRIDKTFNRRMKEEKMKAKAEGKDEESKMSTADHPHADDMSFLEAAELMGTDCYEFNGEYMMDFVEFIKVLRPQDYEEDQLEELYPNTDTQFENIHGLGSDYEMQHEGGTHLTKRE

SEQ ID NO: 34 - protein, 593 aa, Spathaspora passalidarum
MTSSQTVDFKEIDVRTAINALYMIFCTALLPIVVIGIAFFYSGLTQRRSSLTMFAIPILLLPLIFIDWFIWGYSLSYSASANHFIGNLNFAVLRQLRNSITLVFTNTRGEILVLNHFLFNGFFKVICAALTMPGCIAERGRIIPMLVFLFFWSAMIYNPVTYWFWNSNGWLSIDLDNLPVLDFAGGNCIHIVGGFTCLAYSYILGPRNPKILYNYRNINTGHIIFGTFCILSGWVGFIAGCDFKFSSNSLYIMVNTLLAAFSGSIVWTSIDYFFSSIPLADTASITANPEQPAYPEPIIGGSSPESIELKRLHSPQSSHRIQPVISQTGILKSQRYHETKSNFVEKRKFSMISFSSGMITGLVVFTPGGGFVSSPSEFWKPIIFGVVGAIICNLSTRLKYFFGIDDALDIFAIHGVAGIVGSLLTGLFANTQYQSQGGWVKRHWIQFAYQLLGITVTSAYVFILTCVFLLIIDRIPGLHLRIDKNFNARQKQQKTTPELPIHELESQVSPHDVASNKDLFWEQVELQGTDTYEFNGEYMMDFIEFIKVIRPQDYEDNDQSFDNIDQPNYENLTGLGADYEMHPEGVHHLTKRE

SEQ ID NO: 35 - protein, 580 aa, Candida albicans
MSTDVEPMTSLDVTTGLNSLYMLYCTAPLPLVVIGIAFFYSGLTQRRSALTMFAVPFLLAPMIIIDWFIWGYSLCYSASSNHFIGNLNYVVLRQFRNALTAEFTNTRGHVLAGPHVLFNMFFKLICVSLTFPGCIAERGRVLPMILFAFIWSVIIYNPVTYWFWNSNGWLSVDLGRLPVLDFAGGNCVHIVSGFTCLAYSYILGPRNPKLLYNYRNSNTGHIIFGTFLVFMGWIGYIAGCDFKFSFNSIYIILNTLIAACASGIVWTAIDFFFSSVPLEGESVGLKHGDSKLSNSSGDNHSPMLQAIVSRTGVSINQRLHESKSNFVEKRKFSMISFSSGIMTGLVVFTPGGGYVSSNAEFWKGIIFGVVGAISGNLATRLKYFFNIDDALDLFAVHGIPGIVGSLLTGIFANDLYDSKGGWVKGHWKQFGYQLLGLVVTSAYVFIMSMVFLYLIDLIPGFHLRIDKDFNRREREKTLKAKQLDQELESQTSPQQVVPHMSNSTEQMSFWEQVELQGTDGYEFNGEFMLDFMEFIRAIRPQDYEDDDLKDIIQAPNQYEGYIGQDFELHQEGVHNLTKRE

SEQ ID NO: 36 - protein, 582 aa, Candida tropicalis
MADLDADSTSMLDLRSSINTLYMLGCTALLPLIILGIAFFYSGLTQRRSALTMFAIPLILTPMIVIDWFIWGYSLCYSEAANHFIGNLNFVVLRQFRDASTAEFTNSRGHILAGVHVLFNLFFKLVCASFTFPGCVAERGRILPMLLFVFIWSTIIYNPITYWFWNTNGWLSVDLHRIPVLDFAGGNCIHIVSGFTCLAYSYILGPRNPKLLFNYRNANTGHILLGTCLVFFGWIGFIAGCDFKFSFNSVYIIINTLIAACASAIIWTAIDFFFSAVPLEGETVTVKPEDYNLHAVVSSPIEPAISRTGVSINQRYHESKSNFVDKRKFSMISFSSGIMAGLVVFTPGGGYVSSNAEFWKGIVFGVVGGVTGNLATRLKYFFNIDDALDLFAIHGVPGIVGSLLTGIFANKLYDSEGGWVAGHWKQFGFQLLGIVVTSAYVFILSLVFLYLIDLIPGMHLRIDKDFNRREREKQINLSNKLNNQELESQVSPHNGEDSNTAVTESESFWEEVELQGTDSYEFNGEYMLDFMEFIRVIRPQDYEDDEPPEIIQSPNTYETYQGGAGHDFELHPEGINNLNKRE

SEQ ID NO: 37 - protein, 530 aa, Pichia guilliermondii
MEMTTGGIDLDPTIAVNSLYMLSCTTAVAFVVLGVAIFYSGFTQRRSSLTMLVLPLVLFPFVFIDWFIWGYSLCYASAVNRYIGSLNFVVLRHLRDSATTIYVTSRGSILSVNHFLFNGMMKVVCAALTFPGCIAERGRVVPMLVFCFFWSVIIYNPVTYWFWNRSGWLSVEYNKQPVLDFAGGNCIHIVSGFTTLAYSYILGPRNPKILINYRNSSTSYVAIGIFFIVAGWCGFVAGCDFRFSTLSVYIIVNTLLSAFTSGIVWMAIDYYFSAIPYEGNLKSTRKMSVISLSSGLMTGLVAITPGGGYVSNPNDFWKPFVYGVVSAIVCNLATRLKFYAQIDDALDLFAIHGVAGIVGSLLTGIFSNTEYSSDGGWVQGHWIQLAYQLLGCTVTSAYVFVMSIVLLYLIDYTPGLHLRIDKTFNQRTRWARNAHQEETMLELTTSDIEGQNINVPSEKDLHYESLELLGMDAYLLNGEYAMDFMEFIKELRPQDYEDNETINDYDNTQPVDSTDISPFGGMDASTKKSE

SEQ ID NO: 38 - protein, 581 aa, Debaryomyces hansenii
MNSLHYQVLTSIEDVWTIINSLYMIYCTSLLPLAMIGIALFYSGLTQRRSSLTMLALPVFLTPFILIEWFIWGYSLCYSSSSNHFIGDLNFAVLRHMRDSVTNNYNTPRGEIWLINHFLFNGFMKVICVCLTFPGCIAERGRILPMVVFLFFWSVIIYNPVTYWFWNREGWLSVELNSLPVLDFAGGNCVHIVSGFTALAYSYILGPRNPKILYDYRSTNTGYIIIGTFFMICGWCGFVAGCDYKFTIECLYIILNVLLCASTSGIIWMLIDYYFSAIPLEGAPIESALSNHRDKIHVLRISSTNIRTIPSVTGASINQHYHDTKSNFVQRRKISIISFSSGIVTGLAVITPGGGYVSSPTDFWKSFVFGVLGGIIVNLSTRLKYFVQIDDALDIFAIHGVAGILGSLLTGIFANQRYNSKGGWVKGHWIQLGYQLLGCTVTAAYVFVLSCVFLYCIDLIPGLHLRMDKTFNQRMREERERVQAESTESPTSVDIEEQFVPHNTNEITYLEKLELLGTDCYEFNGEYFMDFMEFIKVIRPQDYPFDQFTEETETQYDSVNAIGSDYQLHPEGVNHLARKGE

SEQ ID NO: 39 - protein, 521 aa, Candida tenuis
MISEESNLPIELAINSLYMLFCTMLLFFVLVGVSLFYSGLTQRRSALLQLAMPMLLTPFVLLEWYIWSYSLCYSSSSNHFIGDLDFAVLRQLRESAVLVYATPRGEILSINHFLFNGMFKIICVGFTFPGCIAERGRLLPMLLFLFCWSTIIYNPVTYWFWNRNGWLSTEFGTLPVTDFAGGNCIHVVSGFTALAYSYLLGPRNSKLLYNYRSSNNGFILLGTFFIAFGWCGFIAGCDYKFSTFSIYIMVNSLLAASVSSVVWMIIDFYYSSTPLDGNGHNKSERKISIISFSSGLMAGLVVITPAGGYVSSPTGFWKAIVFGVIGGISSNLATRLKFFFHIDDAFDIFAIHGITGIVGSLLTGIFGESSYGSKGGWVEGNFIQICYQILGCVVTATYVFVMSLLFLYLIDWIPGFHLRIDKTFNKRMREQKLSNTHLNVQASLSPTNNGFDHDTAVGSIDTKFEHGELEGGDQYELNGEYMMDFMEFIKVIRPEDYTEDYAGIEHIPSSNQMMDLNRKIE

SEQ ID NO: 40 - protein, 522 aa, Candida lusitaniae
MTQAFDAKGAVDTLYMFSCTLLLFSVVFGLSLFYSGLIQRRSSFTMLAIPMFLAALVFVDWYIWGYSLCYGSSSNHFIGSLKFAVLREIRSTGQDIYSTPRGDILAVVHFLFNGMMKVITVVITFPACIAERGRILPMLVFLFFWSTIVYNPVTYWIWNRNGWLSTERNSIPVLDFAGGNCIHIVGGFTGLVYSYYLGPRNPKILENYRSSSNANMVIGTVFTVYGWCGFIAGCDFKFSATTFYIIINTLLCASCAGISWSFIDYYNSATPLDGNIHDGNSSNSTTADGHLVPVSKKRCMSIISFCSGLISGLVVFTPCGGYLSTDISFWKSIVCGLVGGITGNMATRVKYWLGIDDALDVFAVHGICGIVGSLLVGVFADDLYNSKGGWVTHHWVQMGYQVLAVVVVSAYVCVVSLFLLYVVDIIPGLHLRIDKDFNRRMMANQNSDTESGENKEYSTRYELAELMGTDWYEFRGEYTMDFMEFIRSLNPNDYVEEVESKEHSGYQAETSDSIQDLRKRSA

SEQ ID NO: 41 - protein, 75 aa, Pichia stipitis
MYPEFVNDKPPVVTLAEYDGASWASTTCLDFRNNQYVVVIMEEPEKVVAVIDSKDYAVLNRIFQSAHAQHAEQLK

SEQ ID NO: 42 - protein, 76 aa, Spathaspora passalidarum
MSYPEFVNGNPPIITLQEYDLAPWAKTTCVDHRDGKYVVVIMETPETVVAQIDPKDNDTLDRIFKSAMETHKQQQS

SEQ ID NO: 43 - protein, 78 aa, Debaryomyces hansenii
MSEYPEYINGEPPVITLEEYDVAPWGKTTCVDSRPDGYVIVIMEKPEVVVARIDKSGDETLDKIFRSAKQTHAEQSAK

SEQ ID NO: 44 - protein, 83 aa, Candida tenuis
MSYPDYIDGEPPVVGMIQYDQAAWAGTTSIDRQDGVYVIVETAEPTKIVAKVDPKDTLMLDMIFQDAHKEYAKQINDKNVQTK

SEQ ID NO: 45 - protein, 112 aa, Pichia stipitis
LVKRDLVEDLLVKVFVSLKRSGLINSIIKMSLTDDEVREGVVDIAADLLERDVIPFEDIFVALKDSGLAVDVIKFSLTDEETRGGVVALIRELLPHLIADGSINPKDLIATP

SEQ ID NO: 46 - protein, 176 aa, Spathaspora passalidarum
NALRDLRNVLCKIETDQVIDKRDLVDKMLVRVFHSLKKSGLINDIIRMSLTDDEVRESVASITIELLRADVISWEEVFVALKDSGLAIDVVRFSLTDEETRNGLGELVKEILPDLLESGAIDPKDLVSGPSDKHGNKNHGKFKDRDDDFDNHKKGHKRDDNLPIEGAVPISHPIAD

SEQ ID NO: 47 - protein, 530 aa, Candida albicans
VGLKNHMNSDSSRNSNSNVNVLKKKRNLKKVKMVVSKVDMQEEMVKMEMRAIAKAKVGSFNLVSQGSDKQQDELTIAKLKENKVVKENELFGMNDEIEELEKRAGKFWKWKGGSKNKEYSGFKEEDYIEEDKVSKKKVIKDKLIGKFKKQGDNEFGLSADDDPDDRDLVDELLLRVFNSLKGSGFINDIIRMSLTDPRVRSGMIDMTIRLLNAEVIPWDDIFIALKRHGLAIDVIKFTFTDAQTRVGLAAFVIELLPALVTSGALDLRQILETVPRLQEESIKMYNGGNRTHNSTDPADSGNRNHGFEDSVGSIIDSENQAESGINEHVIPKKNSSSINPISKETPTPDVPKVTIPSEKNSSDNYNDQVKNDGKESKSSLNDKEKEKPMNLPDVPLIDNPKNWDDKTLEEKVEEYKKLKEQYDEARRKLVTNENSDLIRDHTYFNNPEKLKNIKPLFPKTGVKYTNNTSNGTVGNHAAPYPRVRIFYDGTFVPNYPVDFKPPIAGGPSTNFEPNSNSIKPNAEPTVGVAT

SEQ ID NO: 48 - protein, 591 aa, Candida tropicalis
MEKKKKLKEKKKAMKEKKKEKKEKKLKKIKEKLGKSDEGSSDKGNDKTGSQNEMKKSVQLQSSGMVPLYENFMVSDDENESKTVSKRSESGGYDGFKDDDFIDKDESGSDGNNKGDNNEKLNKLKEKKKELKEKKKEMLEKKKQKLEKKKQKKKEKMEEKKQMLGKLKGMFDKSEEGDNEMKTKSFHSDYVEVKNSELNVLYDFAKKGEDNELVSMVKRDLVDDLLLKVFNSLKDSGLINEIIRMSLTDPLVRRSLTDVTARLLKARVVPWDDIFIALRRHGLAFEVVEFTLTNAETRAGLASFVVELLPRLVNAGSITPGQLLDTIPRIQEEVDSRKSQKGSTYSDNIDSDKTGGTTDGAKDFSGPVKQKPHEVVVPDKIKGPNLTPIPSEIPKEKDYYSEGEGEDEDKCDESNKVQEKPSTTPYEGKQRVDEGKLQVIPNTGNMPYGKPMYIPFARLNQTTSVIPVPNNQDQFLRERAKNNERYGQIKESLPSHPNNGLLDEHSRFNNPEKLKNLRPLFPSGNSTNGSDEVKTPYPRIRVFYDGTFIPNYPVDFKPPIAGGSPPVSSEEDTKIPVGINPPYITNGTITN

SEQ ID NO: 49 - protein, 173 aa, Pichia guilliermondii
MRLYNLVFLYFIAVVFGEYEPIGETQLTNSETQLSKRITPIQALAVAKEVYAAIKELEMHIEEENGGDLVKRDLIDDVLNRIFLALKRSGLAVAIVKMSLEDDDVRAGLTEITIDLLEADVIPYYEIFEALKESGLAVEVVKSTLTDPETREGALELAREVIRSQLPSNSTIV

SEQ ID NO: 50 - protein, 218 aa, Debaryomyces hansenii
MKLHFITLTTLITACCAASIPVDTHKEVNLFKELDLNMSGADALDIEKVAATGLTDLLSKGKKAFSLVNVLKDVLGMISKIDQIQDSEEMGLAKRDFVEDLLVKVFVALKKSGLVNSIVKMSLTDCDVRPAIIDILIELLEADVIPWEEIFVALKDSGLAVDVINDLFTDPETREGLVQFTAELIPDLLASGALSGKDFCVVPSARIQLINSTIPNFK

SEQ ID NO: 51 - protein, 239 aa, Candida tenuis
MDTIDKLETISGLRKRKFRSKIPKFKFLSKLFNKKKAIIKELESILKSIKKIKKLKAETPEISTRGLSEKKDEIIESLLVKVFVALKDSELITPMLEFSLTDEQVRGGLVKTTVDLLKANVIPWEEIFTALKESGLAVEVVRFLLTDPETIEGEIDLILELIPRLIEEKVINLEDLLKILPHTYTTTTKTGTTTTETISFPSGGDSVLVELPITTLLTFFATNQTLVVPTPTPTVNGFL

SEQ ID NO: 52 - protein, 173 aa, Pichia stipitis
MLITSKDSVAPNLSKRIIYYSNNRGWTNHRWLLWLLLAVPLVILLLFYLLRSRRRKTVVGTTQEPFYTQEQPPVSGGYYYGDQGQGNYPGQGNYQGQENYQGQGSSYVPPPMPAKHNAETDYNVSGDSFGGYGGSGSYGGYGGYSQDPNAPPDPNAPPDYSRPEGPPPTHNKF

SEQ ID NO: 53 - protein, 145 aa, Spathaspora passalidarum
MIVPREDQAKLVKRIIYVNSNNNWQRRRWLLWILIAIPIIFALLYFILRSTLFRKKGKVVTTQMPMPGPPPQQYYNQGYHPGPPPPGQGYNMNDLPPQPTPAYVPPSYEQTSYGQQQDTFGQQQGTYGGYHNDEFNPPSGPPPKN

SEQ ID NO: 54 - protein, 160 aa, Candida albicans
MLLPESIDTQSLIKRIVYYNNYDRSGWWRWRWLLWLLILIPIFAMIFLLSRRRRQNKVVAYNNPGPQPNGAYYNNNNQYQGGYQGGYQGNNDLPPQATPGYIPPAYPETSQQQGSYGGGYSSQQQNGYNPQQQQQQQSGTYNSEEFSRPEGPPPAHTKGY

SEQ ID NO: 55 - protein, 149 aa, Candida tropicalis
MIITNIEDSVSLVKRYYTTYNNYNRSNWYRRRWLLWLLLIIPFLFIIIMFFLRRRKRSKVVYNTAYEQPQPPPQQPSGTYYNQGNNQYQGGYYGNNDLPPQQTPGYVPPPYPETSQPSYGGYNAQQQDSGTYEQYSRPDGPPPAHTKNY

SEQ ID NO: 56 - protein, 119 aa, Candida tropicalis
MILSESQSISKRLFNYEYRYRDDWWRWRWLLWLLILIPIIGLLLLMLWRRRKQNRKAVTYTTTTQLPPPNGVYYQQTYIPPSVPQTTQQQQGYYGYQPEQNGNYDYVRPQGPPPAHTKF

SEQ ID NO: 57 - protein, 131 aa, Pichia guilliermondii
MYLDDIYKRYYYNNYRNRNSNWYTYRWLLWLILVPVLFILVALFFLRRRRRRNRQVTMQPNNQYYETQQAGGYYNGQQGGNYGDTSTYPPQQPGYGGSGSYQQGYNREAEYNVNGDDFSRPEGPPPAHYKA

SEQ ID NO: 58 - protein, 163 aa, Candida tenuis
MFLPIEKRYYFYSRNHNTINRRLWLIFLIVIPLVCVLSYVLLKRRRKRRQFISDNNQYYTGAKPNQGWNFFGTGNNTQQPPYPPQAQGQYGAPGQGQNPTYPQQAYAGGTSQNYGNQQQSYQQQYQPQTGDSGYADPPPVYPAGESGTNYSRPEQPPPTAQVK

SEQ ID NO: 59 - protein, 997 aa, Pichia stipitis
MLFSYFPALVALCSTVSALGGLQNIVFKNLKDDLQLAAHKKSATLFLDTEDWPGVVRAGLDLSDDFKKVTGEALPVVNFTGSGICTKVHGKVESAIIIGTVGNSSIIDTLVSAKKLDVSEIEGKWESYVMKVIENPAPCISSALVIAGSDKRGSIFGAYDISEQIGVSPWYWFADVVPATHSEIYVSKSIVKVQGEPSVKYRGIFLNDEQPALAAWVAEFFPEGKYNSYFVHQFYVKLFELLLRMRANFLWPAMWASMFGEDDPENQYWADYYGIVMSTSHTEPLMRATNEWTTFGNGSWDYSTNKDNIVEFWKEGIARSKPYENMWTTGMRGFGDTPITGGVEISLLEDVIKTQRELLTEYFNNTDITDIPQVWCLYKEVQAYFQEGMQVPEDITLLWVDDNWGNNRRLPLANETDRAGGAGVYYHFDYVGSPVDFKWINTVSLEKTWEQMHLAKQKQADQIWVVNVGDMKPLEIPIEYFISLGYDFDTWGPINKVMTWATAWAQREFGAYLKEDDVKEVADIIDLYGFYANRKKYEALNTTTFHLYNYNEAETVLSEWADLADRAWAVYKKLPKNVQPSFFQLVLHPAVAGYTVYDILISAGKNNLYAEQRRNQANALSTHVLDRFQYDNTWKGEYDSLLGGKWKHMMDQTHLGYFYWQQPMRNVAPPLAYVQLEENSLAGSLGVTVEQSRGSVPGDDAYNAVAYSNNTLVLPTLDPYTDSRHITIFNKGIEDFYFEVSPYADYVKVNPSSGSVSATNNSIWNSVDVEVTVDWDQAPEGYNIVFMNITSNTTYEFFGMPTVNLPINKTQAPDDFKGFVETNQHISIEAEHFSNNQSTNDTYYVTIDRYGRTLSGVTLFPVTADSQEATEDYSYLEYNLYSFSAPQYGSNITVYTGSSLNIDPSRPLKYAIAIDDQEPQVVQIVVDPTDPTAMPAHWEDAASDGVWIHNTTHTFDAGEHTLKLWALEPAVVFEKVVVDFGGVVPSFLGPPETYIKK

SEQ ID NO: 60 - protein, 1000 aa, Spathaspora passalidarum
MLFSYIPTLIALLGAVNALGGQTNIAFQQKGSHGNNKEITLHDHSSTATLFLDQNDWPGVNRAAEDLSDDFRKVTGHALPVSNYTSSNDICKKIHGSVENAIIIGTIGNNTLIQNLIKEKKINVDKIKGKWESYIQEQVENPVPCIKNALVIAGSDKRGAIFGAYDISEQIGVSPWYYFADVVPQSHDSIYFSGSKTQGEPGVKYRGIFINDEQPAIAAWVAEFFPEGKYNSYFVHQFYVKLFECLLRMRANYLWPAMWASMFGVDDPENQYWADYYGVVMATSHTEPLMRATNEWSTFGKGAWDYSTNKDNIVSFWKDGIERSKPFENVWTMGIRGFGDTPISGGVETSLLEDVIATQRELLGQYFGNSSVTDIPQSWCLYKEVQSYYEAGMPVPDDITLLWVDDNWGNIRRLPLNNETSRSGGAGVYYHFDYVGDPVDYKWINTISNEKTWEQMHLAKERGADRIWLVNVGDIKPLEVPIEYFISLGYHYDVWGPINKVFEYTEAWAQREFGQWYKNTTEIADIVDLYGFLINRKKYESLNATTYAIYNYQEADTVLQQWSDLSARAWNVYNQLPKNVQPSFFQLVLHPVNAGYIVHDIMISAGKNNVYAEQRRNQANSLATYVQTRFGDDHSWKNQWDSMLNGKWHHMMDQTHLGYFFWQQPMRDVMPPVSICQADDNNLAGAMGVTVDQSRGSVPGDDLYNAVAYSNNTLITPPQDPYTGNTFIEIFNRGNEDVNFKVSSENDFVTLSQTTGYISATNDSIWNSVKVWVEVDWSKAPEGSNIVFIDVTSNTTYGFFGPPQIHVPINKNQAPTNFKGFIEAGEVISIEAEHFSKKVDNNKVNYEVINRYGRTLSGVTLFPVTADSQTSDANAPHLEYDFYSFSTPAYGTNITVYTSPSLNTYPARPLKYAIAIDDEQPQEVQLVIDTTNPLNMPDHWEQAASDTIWLHNTTHNISSSGQHTLKLWALEPGVVFQKAVIDFGGVVPSFLGPPETYRQQ

SEQ ID NO: 61 - protein, 980 aa, Candida tenuis
MYWFWCFLSIVTASIVFEEYDETIPIYTNASTSRLVFDPADWPGVIRAAHDLRKDFEAVTGKKALQVANDTLEYCSKSPTIIIGTIGNSSIIDNLVKNNLIDIRAIEHKWESYIITHIKGCNTVVVAGSDKRGTIFGIYTISGMIGVSPWYFWADVPIESHSSVYFNTSAPIVSGEPSVKYRGIFINDEEPSLSTWVNRNFDQGNYTHYVHEFYFKVFELLLRQKANLLWPAMWKAMFGLDDGLNQYWADYYGIVMSTSHTEPLQRASNEWLYEGEGSWDYTTNEKNITEYWKDGIARGKAYEGVWVEGMRGLGDTAMSDGVESALLEKIIAHQRDLLVEGFGEGTNISTIPQVWCLYKEVQSYYQKGMSVPDDIILLWVDDNWGNIRRLPQGDETSRSGGAGIYYHFDYVGDPRNYKWINTVSLTRTWEQMHMAYERQAREFWVVNVGDLKGLEVPIAYFLDLAYDYDQWGQVNKVPTWTRKWAEQQFGEFAPDIVIDEISDIVEEYSFLAGRLKYELLDRDTYTLLNYNEAQMVLDTWKTLSDRAWNVYNNSLSKAAKPAFFEMILHPCHAGYIVHDLHITAGKNDLYTSQQRNQASSSADHVKEAFQDDFNWKKKWDALLDGKWKNMMDQPHLSYSYWQNPMRDVMPAVSEILLETEAMSGSGGLTIDGALGVVPGDDVHNGATYNNNTLIFPELNPYSGNTWIEVFSRGYEDFEFKVTPWNDYVSVTPSSGIINASNQSLWNSIFLNVSVDWDQVDDGFHLEFLNFTTNSSTYFYTIPTILNLPINKTENVTSFTGYIESQGYVSIEAEHTTANISQNDTYFLTIPRFGRTLSGVTLYPINSESQVATEDASYLEYDFYAFSGSNVTNVTLIFSPSLNVNPFRPLRYGVAVDDDEPEDIQIYEDNTDPTAYPVGWEEAVAANAWTRNTTHDVDAGPHTLKVWLLEPGVVLQKIVIDFGGARPSYLGPPESYFLEEE

SEQ ID NO: 62 - protein, 662 aa, Pichia stipitis
MSLLDLDFDNFLLPPMVQPKLALFSQVRTPMQRKSSNFFPVQTPRDIDDSFDHTLLADPGAIAPPYAKRHNSSPLIGSFNNRTGQSSLSSSSLKFFYANPGSGSGNPQLLTPLFADVSNSTPNSAPASVAPTSAGTNGRQTLSVFGGIDIGADLSNNLHSLNLNNNINNMLSPPPSAASTYNYQQSTPQQTGGSLGLLAISSPPNTASMLNLGGGGSTTATTSGSVTPSISSNSIWNDSNSLGHFGLNGNGNSNSNNSNSNNSNNKNPNNIGVNVNSNILNSTPKLSTLDELFDGEHKFSMENSYSDVFSNDMLFSPFYAHEGHSQNQFGEISSPLAPVARTASFTSSGSRPNFKSKENIYLSKLNTPSFVPSAVMSDGAKVMGSSTIEPTDSEVKLENTRAFINQIHSNANVNSGASSSSGHRGNLVFNNDSATLTSKLNQIERKESEISGRISRKNSGLPSFNITQVNSGIDRGNVRVSLPQTSSLQKQVTRNDVFIREILTTDETTKYSEDYCSTFYKRNSHGYMFTKEPTNTLKVNTTANKSWVQLKIKLPCSSPGQTRGRTDAPALLIKKLKVDVRHLPIWRPITMNGGASSYQGNGYSNSNYQGGKRYGNSNYNGYGNGSRRYSGGSGASGFGNNKEFRKPKNLNVSKRFGKKTSE

SEQ ID NO: 63 - protein, 454 aa, Spathaspora passalidarum
MLSPSQGSMPANNNRNSTRRTSNFFPSGTAEHTNNTTTPSLISTPNLPTPREHFPYRTTSLDSSPFLTNSRYHEMETMNPGGYNGQFTSMSESTTAVHSPVMLATTNHTLGRSLTMDYKFSSQMTNLSISGPPQLPNNVSGFTGSRSSFSAGSAISTGSVSSIGSSSIWNDSHHSSTTILGNSLLDELENDYLFSPFWKEEEAEQELEQKNQEEKLVMQQENLQLKSNIYANKVNNPTFIPSSGLLEENSKSAIKISDKAIKKSKAKKDASGVRLNYKIEAKYEEEEQSLSQKNIKIKLPNIFRDTPESDYFLKDMISSQEANRYGEDYCSTFYKRNIHGYMFIKEPSNSLKVNASGGKSSVSLKISLPAGNNRLLAKKLKVDVKELPIWKPISSGNGGTASFTARRRPNVNSNNTSNGTKETKGIQATQDPPKLKNGNLSKRFGRRNTPKQTP

SEQ ID NO: 64 - protein, 424 aa, Candida albicans
MCPIDFEDEFSILTSPQPAISQSFASFTNVPIIHSTSTTVPSNNNARAQRRTSNFFPPTNDNSVLSTPNIQVSTDSYQFPDISCSTTTTAITESAMSPFTTFNKTALSEPPQSPFYVKTPSSMTTSNLGSPVINKLNQANFNAMNYQLTNSLHDLHLQSSLDSSLTSLAHQHQQQHMHDVYHNGNFHIRLPNISHQESIYNTEQHNILNQQNNYYERSQNHTQESENGFMLSTNSIDTPKLSPVLSQSIWNSEIIPELPKVEKRENRYSNKVNNPAFIPSEHPAEAKNASTDNNSQSPKNTTLDNDDIPPPQPQNQNIKFPKQVKYTPRHNHFVEDMLNHDLTNRYSEGYSTTFYKRNKHGYMFIREATNTLHVHQNSWVQLKIKLPTTSSTVTGNKNNSSSKKLLSKKLKVNIKELPIWKPKP

SEQ ID NO: 65 - protein, 445 aa, Candida tropicalis
MSFKDFDDDYLVLSPQLHQQLQPSSIPSDYGNFNTTSITASNSKPQRRTSNFFPTNENAGVSTPNIQLSSDCFSFQPISNSSSTMTETQQQQSNNISSSNSHFIAFHNHNVKYNENPLSPFYNKAHSVATSTLTSPVLNTFNQPTFNRLDTNGDSLSNNFGNLSIQSLSTTVNTNPTVNTTTSTTSATSLPQTPTQHQSLPQTPQQRFNGFMISNANSTSGNTNNTSTTATTPTTTVSDFSLQQPALSIWNNSINNSFEIELPQSVMKRENRYSNKVNNPVFIPSGPKIPESNIVEESEILSAFTEQAIEDDDEDEFGHNQEDKEPDNKPVKHLPSESNESDQDIDCPRIKFPEKVPYTSKNDYFIQDMVNYDLTNRYSEGYSTTFYKRNKHGYMFIRESTNTLHVHQNSWIQLKIKLPVNNHKKLLIKKLKVDIKELPIWKPKA

SEQ ID NO: 66 - protein, 355 aa, Debaryomyces hansenii
MPLDSLFMSPSSGRKTSNFFPSGDANGFQGSTMTIDDRIDADLERGFKGGNNGEFSGFGIGNTDTGLQGPAGGLGVGFLGDLGDLSDLGDELGKGFGGELGGVLDGELGTGSGVGGHMSYINIGELSLGLTVGVNGSYSIWSDKPNNGQVFSPFVSHGWSPQVEAVGPSEMPSTEYLQNHQMKPVEVVSTSPRKNLYLTRVNNPPFVSQAKKPEKKVRAVSSDQLVVKLPAATRQTRRYPKFRDYFLRENNDVNNEDYCSTFYKRNSLGYMFIREPSNTLKVNNSGPRSWVQLKIKFPEATSAKKLKVDIKQLPFWKPINVNLKDPSRSKRILKDKRKFNVLKRFNNRRDGSLQL

SEQ ID NO: 67 - protein, 306 aa, Candida tenuis
MEDRSSDSISTSTSSLSSRKTSNFFPPPHSRQNSSPVLSSFLSAPITPLLTSSSHSTPVFNDLDFHPPDTNTSIWNTSFTRAYNKSIPDFIGEVHESPSYSYEFARGTSGSFDDRFANFTTGTGLIPVSTPLLMAEPIQTPTKPVPPTTDLARFSIGDRSVRSKSDPTDHPGAEVSTHPPTCHRSRSSSPHFTSNPQPNSSNSHPNSHPHVTVNLHPARRLRQPRLSIQKFHETFSSTFYKRNKNGYMFIRETNDDLIKIDDSTLNLTVRLGNVSREVSINTNTMKDFELVNDFKFIKRKSVSRRH

SEQ ID NO: 68 - protein, 692 aa, Candida lusitaniae
MVEELKRQMSNFFPSVEEGFASIETAAPLTPHLDQGMSLFSPFDVTFGEPLRDAETRAARLKMGPRQSPLASKLESTAASSETLETNALVSHLGSKPRPQNTVSSMQRKAFPAGLAQLRDPFDPFDNAQFVQGNTRQNGFDQKAPGAHDPSHPPRETFPKRENLLDLKGLELNRLKGPFEPIGTLDSDLAFQQKRLLDTEIPFEIKSNGLFKALNGPSRKKSFETEPFGQQFESSLDTNPFKPEVFPLRSSTLADPLSSGPKTDAARNDELEINLDRQLERQLEEQLDEQFDKPAEGQFEHKKANESTLSNHSAQPSFSSSFSAVSASTPFSASILSPHSFSSNMFQSPVPGPLAERVDLSQQLDHLHLAFEALDGSPLRSIWSTPRSEKTDKAIDTPRKNIYSERVHKPIFVPEREDKARERKGEKGKERERERARERESEPAESNSKKGDARKGDKQPKRNKRTSSVISTTTTTRMATPSVSSTCSPRSVFCTSFVSSTPSTYCIPSTTSSAASSTATLSASSAEAPSSATSSSSSFSSSSSSFSSSSTSTSTLTPTPSSKILSAGKASAKAVATEHPIVVNFSGCRPAISDVPLHSDCSRVVLARLQTKDRPENYCSTFYRRNRHGYMFIRETSNALKVNSNGPKSWVTLRVRMGREAHKVKVDVRRLPVWKPINLNPPAGRSRKKARQ

SEQ ID NO: 69 - protein, 54 aa, Pichia stipitis
MASGSSALNYQEQLRRQTIMNSMENKDFLLIVASQQKKSVQQVKYELMLKLVEG

SEQ ID NO: 70 - protein, 62 aa, Spathaspora passalidarum
MSSNNNQYEDLTSPLNYQEQLRRQTIINSMENKDYLLIIASQQNKSVQQVKHELKLKLVNEG

SEQ ID NO: 71 - protein, 59 aa, Debaryomyces hansenii
MSSAHESNSDTSISYEEQLRRQIILNSIENKDYLLVIASQQQKSVQQVKHELMLKLTEG

SEQ ID NO: 72 - protein, 60 aa, Candida tenuis
MNSFEDDFNGKTMNFQEQQRRQVIMNTIENHDYLLVVASQQNKTVEQVKYELMMKLMRKS

SEQ ID NO: 73 - protein, 658 aa, Pichia stipitis
SWNHTPQQIADLTEELIETTKAFNDHIASLSSNLTVEGVLLPYIDFENESQLLINQLFFYQYVSSDKDIRDASTAAEELFLEKMIEQSLRTDVYEVFKKLQEKVDSGMLSIASKEHQLFLSKTMLGFRKNGLHLPEDQRQVVKSYLLKLKELCIHFSKNANEENGYILFSKEELEGVPKLTVDSFEQVDKDGVQLYKMTFKYPDIFPVLGFANNETTRKTVYLGNGDKCKANNVILEEIIALRYKLAKLLGFNSFSDYVLDETLAQNVTTAVSFLTDLRRKLTPLAQIELEKLSEFKGAEVFKWDFKYLENKMLSKQYQVNETEIAEYFPMESTIEKMLAIYEKLFDLEFQPVLTNTSVWHEDVRQYLVLIGEGSNKKFLGVIYFDLHPREGKYGHAANFGIAPGYAKRDGKSRAYPITALVCNFSKKTESKPSLLKHYEVKTFFHELGHGIHDLLGRTEVARFHGTNVPRDFVETPSQSFEFWTWEKSILKNLSSHYLTNESLSDTLIDNLVSTKHVNGALHALRQLHFGLFDLAVHQLEDDESLELLNISRLWNNLSNEVSLISLGNYTVDSYGSFGHIAGGYESGYYSYFFSEVFGDDIYYTLFKDDPMSVENGRKYRDIVLSKGNSEDIMDNLKLLLGREPTSDAFLKEYGLDK

SEQ ID NO: 74 - protein, 388 aa, Pichia stipitis
MSISNTAVIGVFITIFGLMILLSVTLFATITCCCYAYVEENDKNTPGRLKFGLMSPLRTAPSRFGGIHANQVISGPVDLENQLHQVKSYNAPNNTRISPLSSQIVLNSFPISNANQNKSHSNHNTNTSKDNIQHCNTLEYESAVEKFDNMTEGLFDDLKQNPNLRRAHLETIARRMSFIHYKRDGSNNIQTVLARPSEKKQNYISDQYDSFSRTLMLQSLIQDSVNNDERAIKEVRDPFLHHLVSVGGIVVVVKPFQGREEYEFKYLQPGDLLRIVKFYVRQDSDQVSVKSLSMMKRENDNNISHEELINSNKDSVSGEVTLDGYKLHDEEIFVDKSDPNYGKIYCTGIILNTFLEYNSETSDLSLRVKKITSRTTSDYDLLKDFPLN

SEQ ID NO: 75 - protein, 389 aa, Spathaspora passalidarum
MALSNTAILVIICLTFASILFIIFTAGVFIIPCVFEGPLLFKLRSGLINLLQGDHTKDTNIDLENQSSKRPLHSDDVSNIALKSFPMESDGATETTPKERTTSDNLQGEAPSDGSSNLQQCEVSGESSDFKSILDDFDRIAATKITEQRLRRMSTLLIKREGDVVETVIARPSESQQSQISEQYDSLSRTLQLQKEIQTRMNENELSIRQVRDPFSDSFISVGGIVVVVKPFHGSNDYEFASLHTGDLLRIIKFYVRENKDDGSIKSIQIANKTKSAVDLLPTTSSTYGEIAKVSEVAKPAEVTDDGTIDGFKQDICIDNTDSNHASIYCTGVLLNTYLDYNIHTNDLSLCVKKDTELAETELLKDFPLNIVSLETTVLKNMLEEDEDN

SEQ ID NO: 76 - protein, 132 aa, Candida albicans
MRMAPKSPTRPRPRSRNQKQKQKQDYQPTSAITLESSNESFSSEIIIDKSNPIHKNIYCVGLLLNSYLDFNNDQLNLKLKVQETSSEEEEEATEDLIKEFPLSIVSLETTVVKSVLAGEVGEEEEEEQAQMN

SEQ ID NO: 77 - protein, 431 aa, Candida tropicalis
MTTLFQKEKTNHTNNFFLFFVSSIYIVLCHFPLVDYQLSVMTEVSNTALLVLLILVLVFVVILVFIFVLCLPWCCPFFFIGCTRRRRLRVAINEFLEEQLDENKEAIHQINDLENQVDNQDPQNNADAASNVALNSFPMNSTHSTRLQPPVSDITVAAAGPIPEMHTPDPIAATAASEGASQSVINDTRDSDFKSVLEEYLAEDTVGEPVIQTIVANPIDQNTDLVSGYDTYSRTVLLQLVTEACRKPNEQIIRSVTDPFSEKLIRIGEKVVVVKPFIGKNDREFGSLQTGDLLRIIKFSIADVADSDATGSIKSIHIGSAKTKCKPNEIKIDTGDQSEYQTEEITVHRSDPNHEKIICTGILLDTYLDFNSHNNELKLKVKEDQEIDGSNDGETIPFELIKEFPLSIVSLETTVVKTALFGDGADSETEF

SEQ ID NO: 78 - protein, 413 aa, Debaryomyces hansenii
MASNSVVIGSIIGAVIGTCFLLSFVMILYCYWCCVIYVKSPQDEYNVSDLHFRDKQKTTHTLRHMFKAMSWIYGGLRSKDLEDQIDIDKPPSSVTNCDTNLNSNSTFSRLALKSYTLPSEDGETPQVCMGNVKDVNIIPCFNKDDTTSYSLVYKDAIDRFDLSDGLASTNVDRRNSLKAKHLSNIRRMSSLTYRMDDSEPSNFVTTVAKPSESEQSYISDQYDSFTRTLMLQNLIGNSVNAIKKNVIRELYDPYLENLISVGGIVVVVKPFDGVNDFEFNSLQTGDLLRVVRFYVKGELDIDKSKMKHDEDSIDIAESRNNSSTDATIRSGICIGRSDPNYNSVYCTGILLNTYLEYNKQTRDLSLRLKKDAEENEFELLKDFPLRIVSLETTVLKKVSESSVAKDKFENHFS

SEQ ID NO: 79 - protein, 337 aa, Candida tenuis
MNNWQTVSIVLACFLGIFLITVVFFLIYLGCHFSIILESKRYPFTKYEYNRPLDLESGLNSSIIATKSVHTLPTSHVTEEGDIIVRTGFVVGTASHGDLGSLSEFQDSNSFNTDSPISNQVSNFSICHTPSDLRERENTGSQAEVNSTDLGVPAGKLDRYDSFSKSLIIKDLMQGSPSEQPSEIREVSDPYSSNSISVGEVVVVVQSFKGDNAHEFSHLQEGDLLRVVRFYLKEGTGTLGKKGLHLLKITGKKHKFLWSFSPEPSYEDLTYISKDDPEFPLVHCTGIILNTFLEYDASNNTMALKMKDSNHLDTDILKDFPLKCVSLETTVVSHSGQ

SEQ ID NO: 80 - protein, 68 aa, Pichia stipitis
MEATRLTHILDNTYIPPRKIESELTVPPYHPCLIVQDKQTDTTKLKPCGCADSYCVKNAPDWIPRAKR

SEQ ID NO: 81 - protein, 69 aa, Spathaspora passalidarum
METSRLSHFLENTYIPPQKPTRAAVVPSYHPCLIVQDRQTTDVTKIKPCGCADSYCVKNAPAWIPRAKH

SEQ ID NO: 82 - protein, 68 aa, Debaryomyces hansenii
MDSTRLISLLENTFIPPTKTKTEAKIPNYHPCLIVQDSQTDVNKLKPCGCYDNFCIKNASAWIPKSRN

SEQ ID NO: 83 - protein, 67 aa, Candida tenuis
MDQGRLSHILENTYIPPKKSLATPQVPPYHPCLIVQDKQTDVTKIKPCGCADSYCVKMAPEWIPTPK

SEQ ID NO: 84 - protein, 536 aa, Pichia stipitis
MDTLSSHIESNVREASFRKLLSSHLSIYNVLNNPDLDVSPSFSRTQSPLLLTPELPDPSFSITLWQSISNDSKRNENDESGKRRPTSSILSVTTEEDDTTKDSTVLISTPKPSNVMVFETDEEDNDDDRNHVNPPNSFIMPKMSISERPNIHDYSGRSSRFQVTLLSSYGSYKVDTNYLVKSIERELSCDCIGIRHVNLDIHNDYRSSSFLRFDKSLVKNSDLIFVVNDGSSVFLEYLTSVFGGDVQLDEDSMEALPKLTIINMMTVNYFVNLFELINYLKPYQIWKTSSLKQEKLVNKVKDFIEIELNQLDHFESNKVATKDTNLSLVVSNVGRSQTMYSNLILHKRADYKGIEKKFKTDLQGSSSFSDPLLISSNFAHINILYSILMKLFSTSQLSQNIVAVDKSTPKSSRFWLICSFTVGIGFGIGIASGATSVVGLYIYEKFLQFSPGQTQQCIPVSSPATKPIVDTVVDLSKEFQGSMFQFYNEVSTDLIGELRSFSTLYVSYLRSAGDIVIDCIRGGLEKVVGLVVYTNC

SEQ ID NO: 85 - protein, 501 aa, Spathaspora passalidarum
MGSTLLHPALSEPESSPLSPANEPVDDEQSNLDDNKQSFALCKLLNSHSSVFNALNNPELDSPMLFDSPRLRTPEVFLDQSTTQGQQSQFSITSWQSITNEFLQNSPAISRVPSNIKRVTKTSSILSTDDDLPRDYSAIIVPSPSNINAMVFDTDEEGDSEYEIPQPSFIMPKMSFSANSEPAFNKYQVAILSFSHKPEIDQLIGSLRDELSKQVNIIHINLQGEWRNTKSIMQTSNLIFIINDGSSSIVKYLNTIMDKPVEEDSQKVTIVNLITVNYFINLFELINSLRPYQIWKAASLKQDNLIDRFTSFIELECDAEDNSKQIVPKAMYYSSLISTQRQDYKVIEKQFKFDLQSSTTYNDPFKLSKSFVKLDLLFSNFKKLFVSNGGDNNMWLIYSFTMGIGFGIGMATGTMSLLGYYVYDELCGGGKIETEAILQEAPKVEFDSGSTMDKLLEGLSNARIVLEVKEFCTNYVLGFSSTVFVCIQGGLEKVISLFLSV

SEQ ID NO: 86 - protein, 382 aa, Pichia guilliermondii
MVVVSRNGGSPSFGGVMVFETDEEDPSDGEPEFLPNQKSFVMPKMRLSEQQILDIVVLSNSHGAECEALVDRIKNDLATTKMSIANLPVSSVRDSADLSSALRQADLVFMINDGSPLFIKCLETVFDQPDSISAPKLTVINMMSVNYFINLFDLIAFMRPFQIWKTSSLHQQNLVTRIEDYISLESSTDSLECQGTSGIDSIMDLSVTRTSAPNYKQIERQIRHELQDSVSLSSSDPLRLSSSFYHVNILYTIIKKMFQSHNNPSNPHDSGDSKLWLFCSFALGIGLGITLAGSAATVFGFCVSNVITQVDEKPEIKGLSAHPVRAVDVVDDWVQGIVDSQFCCTITRWWDKFSGSMQLFSSHMVEAVIGGFEKVVCMAQMA

SEQ ID NO: 87 - protein, 540 aa, Debaryomyces hansenii
MSGICKMDKTNSKYDSEVKQSITSSSLKKVLNSHLSIYNALTNPDLDVSPQLNSDASGNYPPEINEQFSITSWQSIGNESFNDLSNSKEKVSSSILSSVSDEEDKEKESAVIVPYPTRDKVMVFETDEEDEDIDEDRTLRPNIQCFNLSENPNSFIMPKLTVSDNISNNAHCIFQISVLSSPNYGNHTDAYQLIKYLEKDFSSPLIKFNHFIVNPKLLLFDEKIIRESNLVFVINDGSSIFVNYLCRIFRVVDGIDSDSLDSLPKLTIINMLTVNYFVNLFDLLNNLRPYQIWKTSSLKQDNLLKNLKTLIEIEFSPMKEEYLNKTLTTRDKNLSLTISNNFMYSSLVPSKKPDYKSIERSFKSELHLSTNIDNIDPLQLSSSFSSLKVFNSIIKKLFAFNSGCASNGNSNSYNRLWLICSFTIGIGIGVGIANGAAAILNFYFYNNYLTSGLNSPHFFDSKQLADDTDFTSTQINNSMANFSNNLMDSLKKYANDLKELKCFEEISELPSNLRSASSTVIDYFKGGLEKLTSFFLYSNH

SEQ ID NO: 88 - protein, 574 aa, Candida tenuis
MITDTSQTDSSDKRSESAKADPAHSMYPILDTREFHRKLLNSHSSIFNALTNPDLELYPSHRSEFALTRLNSPTDSAGGAATNGIITPELGKPEVGHNWGMIDESWQCLSNDSIAQTQMLARTLSSSPFIPQNPQNLGRPSSLLSLTTDEDGEDMNHESMVIVSNHLSKAHSHSMVFETDEEDEDNEHRGSHDRFELDTTFIMPKVSMDTPLSNTCRQMTITLLSSCDLSCHNETNQLMSSVQRELGGNVNIVHLSLEKQSLRDRSNDQIIKDSNLIFIVNDGSFVFIDFLNNIFNGLEGPKDISESDYEDDSLPKLTVINMMTVNYFINLFDLINNLKPYQIWKTSSLSQQNLLNKFKDFIEYEMDNSLYCTTLSKETRSKFESSFVKERSNSVYSSLITVKRPNYKKLEKQFKAELSVDSSQVNPLNLDLKRLSCFNAICLVFGRLMNHSEKFSISTPSSSKIPNLYLIGSFTVGVSLGLGIASGLARVVGLYLSDGINTIADSIEPKTLVKEIKVDNSILSKLSNSVFENEDVFDGLVKYLSNLLSGLQSTSSFMVDAAKGGFQKLMAVVF

SEQ ID NO: 89 - protein, 609 aa, Candida lusitaniae
MEQKTSKSRHSQPQVPEDREAKDSRASPLPVVPSSGKLFSSHSSIFNALINPDLDLKISSPPFATRDVFTPPPPKPFPVSAPVALEESAFSYSSWQSVNLPSEMHDSLQSWRNVSPCSASPKPTSTSILSSTSEGNSSDAANRPTSESMALVSSEKEIMVFETDEEDSDDDEITTHVPSAHQFNDDDKTLTNRSVPRKRVSVPSNSQTSFIMPKLSLSDNKYSYKISIVSSANASLRSDTAQLVAYIQQETDYTALQKMHISHLVLASPPFSFDVAAVCSSDLLFLVNDGSCVFPQFLSSLAEAASSGIPKTTVINIMTANYFVNLFEIISFVTPHQVWKVSSLRSASALAKVKSYIDSEMSQHSGSSYTREFEEKRREFASKYDNDQKCDGHESKSRSKQQTSQSMYDGLVPMRKSNYKHLRKQLRAELSVSSSYHDVDPLKLNSSLGHMRLLVNSVTELFSLSPTVPEPGPYQGSYSWKTGCLYVICSFSIGIGLGAIITNKTATGKISRLFLTQAPQQFVAVEQPEASPFSNTLEGMKRGLEHISSSTNAYFDSVMKYGRRMATQNVLPESFADSLVSDLKHFACSLVSSAWNGLSKATGLILGYW

SEQ ID NO: 90 - protein, 390 aa, Pichia stipitis
MIAPNLIQIAVIGAGLIGPRHASHVVNNAHAELFAIVDPSPTAKEIAASMETRYFTSIQNMIAYCNQNGMLYPDGAIICTPNHTHIRVSAELANYGINLLVEKPLSSIPEEAKALKNFAKEKNVKVLVGHHRRFNPFIVEAKRNLHKVGDVIAILGTWALRKPESYFKMSPWRTDNKTGGGVLLINLVHDIDLLQYMFGPIERIYAELLKKQRSHYPDADEGAALTIKFKNGITGTFICSDNVTSPFNFESGTGENPTVPFQNELEGFYRVFGSKGTLSVPDLHLFHQPEAVDDNTNSWLHPIEKEQLVENKLETLHSQMPFDLQLDHFVDVIRGRAEPLCSADDGMSALMCIDAVMKSVETGIPQYVEDIKNIIPDYEALGLDSDLRAK

SEQ ID NO: 91 - protein, 372 aa, Spathaspora passalidarum
MIAPYPVKIIVIGAGLIGPRHAQHVHDNPLTELMAIIDPQPSTTEIADRLNTLHFPSITTFIEYCNTRKLPYPDGAIVCTPNHTHVKVSAELASYGINLLVEKPIGSTPQEAKSLKMYTSMKDVKVLVGHHRRFNPYIMEAKRNLHKCGDIVGVQGSWMLCKPQDYFEIAPWRTQSSAGGVLLINLVHDLDLLQFLFGPILRIYAELLPKRRDHEADEGAALTIKFKNGISGTFICSDNVTSPFNFENATGENPMIPHHSEINGIYRIFGSKGTLSLPEMTLFHQSHIKNSTWLQPLTEEKIEFNREELPFDSQLNHFVDVIRGNAEPYCCIDDGISALLCIDAVLKSIDTGMPVMVEDVKNIKPNDEALGF

SEQ ID NO: 92 - protein, 380 aa, Candida albicans
MIAPNLLQIIVVGAGLIGPRHALHVSNNPQTDLFAIIDPNPATTDVAETFNTLYFPSIESCMKYCDENSIPYPDGAIVCTPNYTHVSVSAELASYGIHLLVEKPIGSTPEDAKALKHYCEIKNVKVLVGHHRRFNPYILATKENLFKVGQIIAIQGSWMLSKPQEYFDISPWRKNTSTGGGVLLINLVHDLDLLQYMFGRIQRIYAELLSQQRTHEADEGAALTIKFESGVTGTFICSDNVVSPFNFESGTGENPTIPQNQGVSGIYRIFGSKGTLSMPDMKLYHQDKGVTSSWTNPINETVIESDLEKLPFDSQLEHFIDLIRGNVKEPWCSIDDGISALLCIDAVMKSIESDMPVKVQDIKSVSADYKKLGIDQGIFM

SEQ ID NO: 93 - protein, 366 aa, Candida tropicalis
MIAPNLLRIIVIGAGLIGPRHASHVTQNQQTELFAIIDPNPAVAELAESLKTLYFPSIQSCIDHCVSNSIPYPDGAIVCTPNHTHTRISMELASHGIHLLIEKPVSTIPEDAKALKEYCQEKNVKVLVGHHRRFNPYIIGTKENLHKVGQIVAIQGSWCLRKPQEYFNMSPWRKDTKTGGGVLLINLIHDLDLLQYMFGRIHRIYAELLPQQRGHSTDEGAALTIKFDNGITGTFICSDNVVSPFNFENGTGENPTIPKHKELAGVYRIFGSNGTLSVPDMTLFHQEDSSWTNPIHESELNLDAEKLPFDSQLDHFVDLIRGNVDEPFCTIDDGISALLCIDAVMKSIETGMPVVVQDVKKIHSSK

SEQ ID NO: 94 - protein, 379 aa, Pichia guilliermondii
MIASEPVSIVVVGAGLIGPRHAQHIKEHKNARLFGIVDPSAIGRKVAEDYNTDYFDSISAMINHCDNQGIAYPHGAVVATPNATHIRVAAELASHGIHLLVEKPLSSRAEESEALKRYCAEKNVHLLVGHHRRFNPFIIETKKHLQTLGTIVALQGTWTLCKPDDYFLASPWRTSNESGGGTLLINLVHDIDILQYLFGPVERVYAEVLQKQRDHYPEADEGAALTLRFVSGVCGTFVCCDSVTSPFNFESGTGENPNIPFHEQLEGFYRVYGTNGTLSVPDMHLYHQQHTLEKTWNQPVIRERVSPHPEVLRSKHPFDLQLDHFLNVINGSESPLCTAEDGIQAQLCINAVMNSIKTGLPQTIPSTSSIHPDYKALNI

SEQ ID NO: 95 - protein, 393 aa, Debaryomyces hansenii
MVASSLQIVVIGAGLIGPRHAQHVYQNPQTKLFGFVDPTPAGDAAAEKFKVRSFKSISEMIQNCNETNTPYPDGAIVCTPNSLHISVAAELASHGIHLLVEKPLSSSAEESKALEEYTKMKNVKLLVGHHRRFNPFIIETKKNLSKVGNIVAVQGVWTTRKADKYFDVSPWRTDITTGGGALLINMVHDIDLLQYLFGPVARVYAEPLTKERIQYPNADEGAALTLRFKNGVCGTFICSDSVTSPFNFEAGTGENPTIPFHEGLEGFYRIFGSEGTLSVPDLNLYHQKNIKIPEDKSWLSPVVKEALVSNREQALHSTLPFDFQLDHFIDVINNKQEPFCTAEDGMSALLCIDALIKSLKSGLPELVEDVNHILPNYDSLGLDEANPVLFKHN

SEQ ID NO: 96 - protein, 400 aa, Candida tenuis
MRSDSITANTTKPALKSGPLNIVVVGAGLIGPRHAQHVNDNDSTMLFAIIDLNPSTKVVAQNLNTNYFSSIEEMIEYCTMNGLKLPDGAIICTPNHTHVPVAAKLASFGINLLVEKPVSPTAEESKALKIYSNFKKVKVLVGHHRRFNPFIIATKKNLYKIGSVVAIQGTWALKKHEDYFKTSPWRTNSETGGGTLLINLVHDLDLLQYLFGPIYQVYAESLPKKRGYEKVDEGAALTLRFKSGACGTFICSDNVPSPFNFESSTGENPTVPLHDNLHGLYRIFGSNGTLSIPDFNLYQNHPELSESNTWLNEIRSKRIVDPKVLMKQKPFDSQLNHFVNIINDNHIPNCNIDDGISALLVIQSVQKSLQTGLPQVIPDITDIKPDFISLGLDLDSEWLS

SEQ ID NO: 97 - protein, 384 aa, Candida lusitaniae
MTLSPPLSIIVVGAGLIGPRHAQHVKSNPSTTLSALIDPSPNAKKVAQDLQTPCYSSIEEYFVYLQENNLNAPDGALICTPNHTHIKIAADLASRGVNLLIEKPVSICPEEAKALKCFVQDKDVQVLVGHHRRFNPFIIAAKENLDSVGDVIAVQGSWALKKPLSYFTASPWRTDSRSGGGPLLINLIHDIDILQYLFGKIERVYAEPIKKQRTAFTNVDEGASIVMRFENGITGTFICADNVTSSFNFEAGTGENPLIPTDDKIEGFYRIFGSKGTLSVPDLTLYHQQDLPDHEHGWNSPVSQTTLLNKRSHLRQLLPFDAQLDHFVDIIRGKADPLCTIDDGMSSLLCIDAILKSLATELPERVKSVKDIEPDFEALGVVNT

SEQ ID NO: 98 - protein, 394 aa, Pichia stipitis
MTIIRRLLSTSNWKPPESYFSHSPLNYESYSRRLKGAIHYIAQNGRFTESILIDCIRANRQLQQQNWNSSPIIQKTRSRNDFLNLKLSPSNSTLEDELFSFVFNRHQERSSSPEIVRSYLITEPLPSNTARVIDVGVKGFEYSFLKQKVEPSLVFTALRLLLDRKDYQNSFKLIDSTFNCDAYKELQRHQIGRNLFGWFLYIAVATVVQAILFPLVSILALFSVNTATAGILMYGLLRLDTAENLGRISWRPYVSMLYKFTHRDELLAINTVITHFEEHNEVNIKNYHHSRVRKLSNLKLFDQDEYVLELPNDSVELASVEYSGQTFQEEKGIVELQQYFKHELNSRKMVFNDLPEELIFLEFWFTHGENFEWVEPDQDPAEIIKLDIQNQKTD

SEQ ID NO: 99 - protein, 372 aa, Spathaspora passalidarum
MRFIRLYNISHHPLNYHTYLSRIKKLPKVYHESTTPIKQQLLLDLVKANRTLQRTNTSPNYAPTRLNLELSTPTNAKLESGLKKLLFHDFRRDALDDVQVVKEYLLTEPKPSNVQDLIEITSDSFRNQLTHKKDVDTSIVYITLSRILDQNDYFNGFNLIDKTVNSDLYLDYRKSRLMKLVVSATLANIGVLALQSTLLPDIPLLAWMLLNISSTALVSSMANLKISNLGRIKFRFYNSQLYNYLHKHELITTNKIITHLEEFNETNLINFHYSKVRPEPNLKTFTVDNYIVELPDAVVETNAHPWTHLPNEEISNIQKFFKSELNKRRMVLCDLNSELLFLEYWKNHGEGFAWVEPDQDPGEIIKLKIKQM

SEQ ID NO: 100 - protein, 355 aa, Pichia guilliermondii
MKYGGYFCRPPLNTETFVRRLEKFAVEHPTGSHPSALVDCIVAARHLQQNHHRKPHTISTKWSDLLQLRLVSNHEIETKLWDFFQKHRSQIDANVASRYLLEHPQPKVSSRIIDLASTVAEPSITRVALRTLLHQKDYSNSFNLVDRVVCSHRSLRTGRQEWLRTMMVSQAIGAAWGIAEASVLSAEWSHFCVSNMALAGCLALGLNLVQNGSGLSRVKWRPYMSSLYKHMHREELEMVNRIVTHFEEHNELNVRNFHVSEARQNTPLNIFSHNDMILEAPQSEIEQEGVSEVVKVSNMIRLEVQKRKMVMGPVDEEVDFLEFWQRHGDGFQWVEPDQDPAEIRQWKLQEAEKHN

SEQ ID NO: 101 - protein, 406 aa, Debaryomyces hansenii
MIKNGVRYSIFRISRAYYSTRYNGQYFSRSPLNYETLSKRLNLFYKLYPPKKYKESIPGGLFINYIKANRSLQGQNTRVNSKIGFNTNQRNKSTNFLDILTFSNNDMETKIQEVFNNYSNETYINDEIVKSYLLIEPRTRNIHHLIKTVRENFQRNLKKERVNKSVVQTALNVLLTEKDYYNCFKLIDLTYCSEEYLKFCKRVNYTSLGSILLSSLAVTILEGFLLPSFPLFYLVFLNLGVPLCIIWYIMKVNLVAHLGRVSWRPYNNFIYINSHQNEILAINKIITHFEEHNEINIKNFHHSKVRQISNLNIFHQNDYIIELPNTNSLLPIDDTNISNEDSEILKLQGFIRQEIRKRKMVLNDIQEELMFLEFWYTHGENFEWVEPDQDPAEIIRLKITNNYPKV

SEQ ID NO: 102 - protein, 379 aa, Candida tenuis
MHSRFPFLLRQLSSRPDHFSRYPLNNESLVKRINWFKSASSSLPPPSIFPMLIDAINATRQIQLQNTPQVHQSDFLSISPSESNDDLENQLVQLLQHYKSHWNSTNHLIRHYLHEPPRPNSASVVDLVSSSFLSQLQYGRVDYGLVRSGIDNLLHTNDYASSFKLVDATLYAPQFTQHSSRVLRRTLSWVSAAFLAVNVLEIAILPLISPAFLVLANTALAVSLGYGFTNLKFPRHLGRVSWRMSKSPRQGVLHNEELFLVNRIITYFEENNEINLKNYHTSQVREFSNPNISRFNDYFVELPTSTAVTAVGQHGQYIDENIVALQQMFRRELIGRKIAINDLPEELHFVEFWMTQGENFEWVEPDQDPAEIVRFRKNS

SEQ ID NO: 103 - protein, 361 aa, Candida lusitaniae
MARGFFSAPPLNYETLARRLAIFHKRRATPSLLADYIRANRQLQRTTNQTRHLSPGQNDLGLKVNVASSTLEKELWAVMRRYWSMCVASDLVVQTYVLSADNADIGPAFSLVAANHKQHSQDLSPGVMALVALLLRRNDYHGCFKLLDITLNSAESKEKRRGQWLSTLGLGIVGATGAGAFVSTCLPLTPWLLSFGVASVCVLGPFFGLRTIEAAAQGARVAWRPRTGFFHRWSQRHEWQLVNRIITSFEEHHEVNGRNFHTSEVRRAPSLAMFDSNDYELHLPQSRALTFPGENFVADERADELARYFRGELQRRRMVWNVLEEERMFIECWSAQGENYFWGEPDQDPAEMVQFHSRAKY

SEQ ID NO: 104 - protein, 709 aa, Pichia stipitis
MLDVQFRHLRSAVTYLGLGLRGFHSSEGLFNSNLRGYLRSGTTKYRKQKADRTTKDGVAKQPSRLLKYDPNAQIADFTTFGVFPFLQKKLNDFLLPETQKTNAIPDFNASPTPDQKRILSVLKSGHNLLINGGFQTGKSIAMLTYCIEQTLSTTPAFDHHNRPDRVQSLIIVPTDELVNRYATYTRYLLKDIPPNCCPKRLVASSSSQRKTVYTLERGPMNLAFLSHDSKPQFYSTNVDSHNVGVPNIVVTTAALLEKAIQGQLNLEPSALQDLKFIGVDELDIFLLTTSIGEWDVVVQEGNKNKYVNKIEKMIQKLKSDLISCYSDSLTNDLERVEKKHYFKMSSESSFNYSEIVINNRIDDVKSFIANEFKGTSKPDLSLLKKLIKLKRKNLYKPIQYCFLNSAKSNQAYNFGNLPSLSKPEDNDLLISFVDKALRLTNSQKKWKENERRLFQVENFSIPNNAILDNSGKTVFGGIINAYILNSSKSKVKDVQLENEVRDDLSFGDWKNLEKTYLRLKLKQISALNEDNYVSVVYETLCIAKKLGITKPFLIMIPEGVDNSMVAASLQQFGNIGKISCLSSGTVHEESHVIAHPSQLLGNTIPCVSNILVVGIESLLPEFALGKKATCTTKDNIPGLVDPVSDLSIFYLSRLLSSPSSVPKNLIFAISNWNLDPQDIQVTNDLNKLSRSMAFNGLLNHVRLKKTSSN

SEQ ID NO: 105 - protein, 598 aa, Spathaspora passalidarum
MSKHAVDSIIIVPTDEIVEKYHSYTEILVKGMPEKCVPDTITFTEEPNGEDFPPFEVERVPLSVQFMYHNSAPATVSSATGNPQVLVTTLDKLLQIYDNEESRSDLASVKFLAVDNSSLFFKCTDINGISLIGQRENNGHFYNHLTLLINNLQQLKARTLYKETVTRLELVEHEYHRNHDVTNTKNHTKLVMAKDPTFADPGLYKRLSWELDFLNNQEIQFCFTMTPEHVHKSIITMNQNEKLKQEIESLKLNGEFEQVETLEKSLAKRQSRNDTYVGIFSDILNYEYQYQDVYKPRRFMSKHAVDSIIIVPTDEIVEKYHSYTEILVKGMPEKCVPDTITFTEEPNGEDFPPFEVERVPLSVQFMYHNSAPATVSSATGNPQVLVTTLDKLLQIYDNEESRSDLASVKFLAVDNSSLFFKCTDINGISLIGQRENNGHFYNHLTLLINNLQQLKARTLYKETVTRLELVEHEYHRNHDVTNTKNHTKLVMAKDPTFADPGLYKRLSWELDFLNNQEIQFCFTMTPEHVHKSIITMNQNEKLKQEIESLKLNGEFEQVETLEKSLAKRQSRNDTYVGIFSDILNYEYQYQDVYKPRRF

SEQ ID NO: 106 - protein, 631 aa, Candida albicans
MILRSPASGKRLPKIYYQSYFLSTKPQSNTESFAKYGILPYFQSKLNSWLNPGSQVKTPPTEIQTFILQNLLLNKKNVIVNQSNKPGKSLGLLLHALNLSLTKRPWYSVESRRIPQKPARSLDSVILVPTDEMVSKYHKYCEKLISPMEKNCVPVEVFKTNGSLHITRDPLTVKFLSRKKLPEITTDSSDSKLDTANHSQVTVTTLSGLLDTIQNDPDQFKFLRFFAIDQLDYFMKSVDLNGFSVVSQNAKGKYKNRLLETIRQIETLRKDTREERLTEFVKLAARDLNETLTSQQIDEIVRIVSERRVAKFPKKFVCSDLMKEELAERLRYECLDNIQYCIVANPSHPHVLALNELFLQKDLASNSASDIEKKQLYIKNPETFKLKNIINRRFAMEDSLDLFKPLERTNKIESYFPVFHDGQVEDYKNVFNLPSHDQVRKLLEHFVGSKSSIKDYAKKYHSEKKLNPIEEYAEFINVISLGFKKRLPGSSLTVIVPAYINPEELKTKLAVELNDTIDRVLAVPDFLVSGTNLESESFMFAGLDTLMYQTAFTEGNIDKKLNLGVNEPYGDLLHVHIWRLLSSTSVSRKKRVIFALNGNNASSEDLSRIGQIFAFNNISGQLEIKPFVRVS

SEQ ID NO: 107 - protein, 700 aa, Pichia guilliermondii
MCDEHREFEINCMFVRYRWRNIQPSFLQISKRYASTNKVRNDPRGPFTKLKFDPKENGNFSNFGVLPFLQQRLNQLEKLNDDHDNDRFRKLGVLPKDHSRDLSPTPDQRIILSVLGSEHSLLFRGDSYSGKSLSIAIHALNFTLSRVPKFGQISSGYSVDSVILVPTDDLVKKYLKYFRFLTKGLPTDCCPDQLVPEKEEYKVSRRPLEINFVYTDMNSDTLTTGEASKTPPQILVTTPSIFHRLLNQKSQLGLGPECYKETQLLAVDGSNYILETTDIQLPENVSLTLEGPKRKYRNILKSIVSTVQKLQMDHYMDSLRRRLKSVEIKAKDQDSDPIPRGFDYTKWTLASNVSALDVEKSIKKQYPKNDRPNLNLLRKMVKTKRKYLYKPLQFCFVMEPIYQKPYRKLIQLDGSKVSRGPAQVRQLQDQLDVKKAKDHNMRVTDPQRSFVERIVRFSDSERTIRKSGRNLVVVGSQDYFEPTNSIQCFLHKKGDKKLKEIDTTANWPANEFHEAWLEASLSENEQKRSLQQLLQKSLQNLASDQILHIIRNSMKNVQDGAVFVIPPFIDLEDIKAKLVDSNNSACTSLMEPSELTVLTHPDALLVNKVRTKHLYILGLECLYPQAALSSWSKFSVNSVPGIEIPFTDMLRFYLKRCEDFTKVSIVLLDPEHLEMLSRILLMNKLQISSKAGLKLTYRKS

SEQ ID NO: 108 - protein, 853 aa, Debaryomyces hansenii
MYIPTARKRLLRNGVLGRVACLRNPWIFHRRNIQIVHNNASVQAEQVQKKRLNLDSVASLKYDPSDDLTDFTSFGILPFFQEKLNRLLRPDDRSITSAPDYNVPPTHDQRTLLSVLNSEHSLIHRGSSQTGKSLALLTYALNHTLSKVPNFGSLKNSRSYQSVDSIILAPTDLLIGKYEYYAKELTKDIPEMCCPDQLLVDGSDNDYSVMRKPLSVKFLYSDGTTKSLCTSNNSEYSSNIPQILITTPSKLYEIMNDEKSVDNITKGNLNEVRFFAIDEMDFLLNTTNISTTSNTNLVNSGKKSKYLNKIEKIIRELQTSQIKYYTSHLIRRLKYVETTHRNANKEAFDNNKFDHATFVLEDNTLSTSNVSTNLELLLSHNSTNSRPDESLLKKLIKVKRKVLYKPIQYCFIFHPKHSYQQILLQLSNKKYKKAFDETIMKELQKIHNVSRNDDRLQNEYSKYLLEKVTRNDQKQEDSQVSFIEKLVRFDDSKRFYRKQERKIVSVGSFNLDNKIIDTSKEASENETSSSISKIQTHFVEARNIKKNSNRVLLRDINITKNMPDKVKTISVLENDIENSGYNIKNLLKSFLKSRMLSTSSLLKKDKGFINNQMIVTEITRATILKFKMEYPLNTDPILIVMPPAINVESLSDELSMDKSSPDKFTCLNTEEFRTKTECASPNFDYLALLNFFLKQSPKEYDIRTNLIVHPDQLIGQNISGLTNLIVIGMESMLPQLAFSSKDLTVDEIAGIDDPVSDLSSFYLSKLSSLSNSNVKNLLFVLDAFNKNDSKILKSRISSDFQRLSQIILYNDLQERINLSKLCEEHPAMTELAYGIDKSFYQRVRNDINKHVYK

SEQ ID NO: 109 - protein, 575 aa, Candida tenuis
MLLYSINQQLQGWRDINDTVKNQHPIHSVIVVPNNSLLLKYRDWASELISEIDKDCCPIKVDVSESGKEIIVRESLNIQFIESSKRFLNMSTNFSIDPLSPNFKPQIVIINSATFNKIFHNKKDIPGLPTKEAFADVKFVGIDEANFLFGASLASDMNPNIVVVGEKERLELYLHQSLKKLREIQYNTFKSRVEADTRCKFCPIQYCFMFHAQHPFHTSYVQMINGYKNLDKYNDPEAELVEKLTQMTNEEFALFRRELPLESVGELVRQHFYKKDENGNVVKRINLSLVDATRVPPKTRTLGYQSLKQFEDFPEREAFMDEFKVYAKEYNHQGNNVFKAYFKDKLMVDETRRSTINDAHFVHRSILQFRKTFPDSKDPILFVMRPTSHFPSMVRKMKSLLKASKKEPIELSCYHKPRNITSNQTHMADENEPYIDNPEDFKNFFIKNPTTNLLVPSDEFPGLDITGVKNIIICGSANWPTLATVSWNSSMSEAQKKLVSGIEMPHTDLFYYHLSKLQMENDQDDRNILWIQDSFYLKKSSITKRVIKQDSKSFREMLLYNDIISLVNHVPPHID

SEQ ID NO: 110 - protein, 410 aa, Pichia stipitis
MSTQHLSQDSLFVCPPTSPPLLNTSILHLVKSLQSESIGPNYASLLDQTYHLIRHPGFSQSQLLRLWHLRLVLHLFNNRLNYAKKEAINLNNALYLHENNNAVPPNSASLATSDSASTTASATTNVSRLNTNNLTPIYPLPKNNWALIDYDLLILLLRLKSLPNLNLINEIYKLNYQLRLKSSSELKHKLINLSYDIVVVLLITKNYLSLLNYLINLRQELKLLPNPDEHYQQYLLNVTLLIIIVETLVLNLRRKSTPDTNVEELVIPKYKDSYESEVQPFTKNSLLHSMQTLQPTIPSQDSEITETPAASVYVKQDITLEELVDSVINGSVTTRIICSTLGLWELCNIFPHFKLESSEDGKLQFLSRKEKSDVSEEQLQEFDHDQLLDLAYADLNNHWYKYIYKIYGLE

SEQ ID NO: 111 - protein, 355 aa, Spathaspora passalidarum
MTSFLSKDSLFLKLPTSELAKEPTLLDLYTNLQSSTHNYDSLITKTYYLIKSPSLSQSQIIKLWSIRLTLHLFNNQLNYAKKEAIKLNNALYLQETTSNPDPPSRTSSLTSTSSSPMTPIYPLPKSILDFKLLVLLLRLKSIPNMNLVNELYKLNYQLRIKGVNELSEKLNNLSFDVIVVLILTKNYLTLQSMLINLHSQLSESGDVNYNKYKSQVLLLLIIIDSRIYTNKAFVEAEYSDKFSEIDQDTKNALVHASTKISQSEIAPEFTLTDLIKVDITDRVIYSILAIWDLSNIFPFKLTNNDNIIEFSYQELEQEQKEEDPDDLSSDWLVDLAYDELNKHWGDNITKLYALE

SEQ ID NO: 112 - protein, 430 aa, Candida albicans
MTQYLSKDSLFLKLPTDLSKDEISVQDLYQDITSLTTTPTPKVTFDSIINKTYYLLKSTNDISNALKLWQIRLTCHLFNNQLSYAKKESINLNNTLYLQENHNITLPPPPPAASSSSSLSLSNGSTPNATTTTTNNNPIYPLPKNNQLIIDFKLLILLLRLKNFPNMNLINELYKLIYQLRLKRNDNINNDQISLLLVKNLQNLSYDNIVILTLTKNYLTLINFLSNLIQELKELKDSEDKKQNMADSFDCDYYSNINLIYLIINLIVHHKNHNQNHIDVVINDTNFNHIWDTQINETTKNSLIYTLQHIPPSIASKPDNNSQESSIQFKCDTIKDLGQLVQEGKITGRIICSMLGIWDLSNTYGFTLSNNSNSDGNSALQFTKINSQEDHQQQQHLDINTLSKDEIITKCCDLLNDQWCNYINKVYGLE

SEQ ID NO: 113 - protein, 385 aa, Candida tropicalis
MTTSTTYLTKDSLFLKLPTEPTTNSITLKDLYNDLSANPISYDSIINKTYYLLKSSLSSSPSSELTVQTCLKLWQIRLTCHLFNNNLNYAKKESINLNNSLYLNENHNISPSSLNTISGGANGNNNLLYPLPKNNLMVIDYKLLILLMRLKNFPNLNLTNELYKLIWQIRLKSNNSPQDDTNDMNIILENLSFDNIVILIITKNFIPLINFLNQLIEELKELNKSKENQYYSNICLIYIIINLIVYCKKGKLGGIFDNVKQLWENDVNQFTKNCLNYSLQKISPIITQSNPSESIHKCETIDDLVELVNNDLITGRIICSTLGIWDLINNYDFTLAESEDGLQFRGKTSANKDISSLSDEDLANECLKVLESQWCKYINKVYGLE

SEQ ID NO: 114 - protein, 354 aa, Pichia guilliermondii
MELPLLNSSLFARAPPSSIVNFTLDQLNADIDAQKPLSSLIDLTYHLLQDPSVGSENKLKLWKIRLTLLLFGNMLPVAKREAVNLNNALYDSENQSITETNTPKVNPLPKNNNGLIDHELLVLILRLKSTPNMNLVNEFYKLSYQLRLRSSSADRETLLWRLSRISFDVVVVLVVNKAYSTLVNLLGSILHELKLTKKGDHYTKHASNVTLLWIIAGCLLKLSTTKGSTYLDEITKVYGTYYDGLLDSTKEALSMVLSEVAPLIQNSKPPLEDHQYDVSLEQLGRFIQDGSITSRTICSLLGIWDLQYCYRFQLKDAKLVADEIKGGMNNSINLAERKVEKMWSSNYSRVYGLE

SEQ ID NO: 115 - protein, 397 aa, Debaryomyces hansenii
MNTINKQFLSKESLFLKFPNVPLDECNIEDLLVGIKSKQPYNELIDLTYYLLKNNSLSLSELLKIWEIRLILHLFNNQLTFSKKEAINLNNALYLNENNDIAPPQGQQVQNPNSNNDSRASSMNSGIGNTPSPSPGLQPIYPLPKNNNGLIGHSLLIMILRLRSIPNLSLVNELYKLCYQLRLRSSGAEEEKVGLQLKLINLSYDIIVILSITKNYHTLLNYLESIRYELVLQKKQNQLSDMYRQYLSNVTLLWVIILIMVYVRNGTKKDRLTDIITKHYQDTFENDVNELSMNSLSYVLSHILPLPSSEEMATVPPGALTILHLVQLILLGDISGRIICSTIGLWDISNVHGYSLTKDDEFKLNHQPSDASDNLSSCYNELTSDWGRFIYKVYGLE

SEQ ID NO: 116 - protein, 371 aa, Candida tenuis
MSLTPEIVAQDVLFAGPPPTTSGGSFKELYESIRSKSSVDSILGQTYTLIRTSTDLNDSITLWEIRLLVLVFNNRITQAKYEAVCLNNVLYLAENDNVAPAAVSSIPPNPQNQRVYPLPRNNNGVIDHKFLVLLLRLKSVPNMSLVNEFYKLCYQLRLKSDNYSSDQLSVKLMNLSFDISVILIINKDYLTLLNLLDSMKSEIELDKSELYASVLSGVKLLSILTKILIFDQTQTPRDAIKRQLRTSHSDDFHLVVDSALDDLVYVLNNISPIYSATLTEKDERTAATDISKADIDLDRLVSMVLEGKITGRILCSLLGMWDLKNNFKFAIEESEFLGEDLVSISNPTVSDCCALIRMDWLKHINKVYGLE

SEQ ID NO: 117 - protein, 386 aa, Candida lusitaniae
MSGYSYLISSSLFVSQPQESDTPVESFYDEDYVRNSSYTDLIDLTYHLITRGANKSEKELLVLWEIRLTLLLFNGELPVAKREAINLNNALFQHENPNSPIPPISTNANPSPLLIDNNGSRGNTPRLSPAPNVIYPLPKNNAGLINYSLLMLVLRLKSMRNLALVNELYKLCYQVRLKGSSSKAMSVQLKLFNLSYEIVSVLITTRNYYTLLSLLRSLRRDTTLRVHKSNVPEPQYQTFASNISFLWIYANLVVYSTKVSEPELSTYADQFENEWSSIEDGTKKSLLHVMGTYAPLIGGPKPTSPSLREQDFHIRTFANMIATDKVSPRIICCTLGTWDLENKLDSNFDAGEGYFDSGTSSQSLSKIYAYILSKWSDHVHNVYGME

SEQ ID NO: 118 - protein, 187 aa, Pichia stipitis
MIQKFTCVPRSDYNVIIVSNGTVNQIESKLIEINEHSNNEIPVNAQITYLDNFRHLVKHLNRLPGKTFNGKVLFMFFNGMSYIQDILSDLIDHYNKCTLFNSLPYFKYEHSDPADTNQFNTIMTIANDILKKMSFMTGRIRGLYIDDYELNGEKVYPLQRLMRNFPSVERIELSSYAQLFMNDMILA

SEQ ID NO: 119 - protein, 215 aa, Spathaspora passalidarum
MIQKFTCVPRSDYDVVIVSNGTVAQISAKVSQINGQLSQNEIPTNSHITYLDSFKSLIAHLHTHTADQRFKGKVIFMFFNGLEFIQEVIGDLIDHYSRFMLMSYSSKNQKIEKLDNVYFYFDSSISEAPTEPSDPYDMFMYNNHSYEYHFNTVAIIANDIIKKMNFMIGRIRGVYIDDVNLHGERMIPLQHIHRNFPKVERIDLSSYHMMNDMIV

SEQ ID NO: 120 - protein, 172 aa, Candida albicans
MIQKFTCVPATDYDVIVVSNGTESQIKSRVTTAKTARITYLHDLPSLSSYLSEVPNFTGKIIFMFFDGIQYIQDFICDAIDLYGKTPFSLIQNAYFYFDKLDPVNLDLQFNTVAVIVHDVLKKSNYMLDRIRGVYIDDLSLVGDRSIPMKRLICNFPNVEKFVLQSNAKITF

SEQ ID NO: 121 - protein, 199 aa, Candida tropicalis
MIQKFTCVPITDYDVIVVSDGTKDQINSKLSQIKDLTNKRIPKNSHITYLPNFTSLCQYLADNSSSKSYNGKVYFMFFNGLDYIQEFIWDVLQTYGQSIFDSTQPHPVQLKNTYFYFGLKQESELLDPFIMNYSKRNIDDFNTVAMMVSDVLNKMGYMLGGVKAVYIDDLQLVGERSIAMKKLINNYPKVERFELASLC

SEQ ID NO: 122 - protein, 202 aa, Candida tropicalis
MISRFSCVPIFDNDVLVVSDETNDQIQSTLYKLTDITDAIITENCHITHLQDFKSLTPYLSFETSISRNVYFMFFNSLDYIHDIIAEALDYYYELNQPVQLENAFFYFGLNQNHYPEQLDPFVMGYTNHSVYHFSTAALVVSDVLNKLGYALAKVKVVYIEDSELLGERSIVMKKLVINHPKVQKFELSKSSSLLVLGNMNI

SEQ ID NO: 123 - protein, 223 aa, Pichia guilliermondii
MIQRFTCVPAEEYEALVVTNGSVDQVESSICKINDQCHDFTRCTIVYFDNLRDLFTHLQHNENTTYHGKVLFMFFNGLEYVQEILGDLIDNYNDRWQPRSIPYNYSLTSIVKAGTDAQGAAARSGTAASCMERLDNAYFYFDSSVCNQGDAVDTSFLSIVCIAQDILKKSAYLIGRIRGLFIDDANLAGERVYPLHSLFRNFPAIERVELTSAASVAFNDLVL

SEQ ID NO: 124 - protein, 231 aa, Debaryomyces hansenii
MANISKEKTDHKMMQKYTCVPICDYEVLIVTNGTVSQVEGKLTKLNEQNNDEIPLNSSITYLKTFKELVEYLSFYKDGNNDEVKYTGKIVFMFFNGLEFVQDILCDAIDHSHKCTATRDIPFDYHMRSMIDKAHDYNDKSQSVEVMQNTYFYYDSTVMSDDADFNMVVSIVKDILKKTDFMVGRIRGVYIDDEHLEGEKAFAVSNLLRNYPNIETLQLTSRKTIMMKDLIV

SEQ ID NO: 125 - protein, 203 aa, Candida tenuis
MIQRFTCMPTSEYDVLVLTNGSVSQVENKLQDMNEQLDNALPKHYRLRYLNSFADLVQFVDDFKADTHKQVDFAGKIFLMFFDGLEFIQNVLSDAIDYYQRCLMRKANFDFDAINCYFYFDSSIFDFGDLDFENGFNHLITIVSDVLKKMNFMVGNIKGIVLDDFDLKGEKIFPIHCLLRSYPRIERIELASDAAVVMRGLLT

SEQ ID NO: 126 - protein, 213 aa, Candida lusitaniae
MKKFTCVPTIGEDVILVTNGSQDQIERTLVLLNEHTCNSIPLHANIIIFNSFKDFVTHLDRTRGDSPVSTYSGITVFMFFNGVEFIQDVLCGAIDYEHRLLASMAEDAESFHLSKLSNSYFYFDGSISVDYERASPASLLRDGHQFHALMAVAHDIMKKTSFMLSRVRGVLVDDIRADGERVYPLSRFVQNFPNVDRLELSSSAPILMTNMLM

SEQ ID NO: 127 - protein, 153 aa, Pichia stipitis
KSKKISSISIIKFKRGKYTYVIPIEFEAKGAKTLENIKRLLIEAIVASGGLTLIEEDPLPEDEEDLDEDNIPVPKSEYIQDEEDIDNPNIISELAPIDIRLAVPKDKTNPYGNEWIELDDNNLANIDFNDYDILAFAYGTEESFEVIEAAYEE

SEQ ID NO: 128 - protein, 149 aa, Spathaspora passalidarum
MPPKKSTVNLITVLKFKRSRITYTIPFTSTTSLQHLKQQVADAINNSGGVQSDEPEREPVDEEDDEENIPVPKSEFIENGEEEQAEVLVTPEQLRIAVPQDMSSPYDNQWLELDDSMLQKIKFKDYNILAFGVDDEPFDIVEAAYEEDE

SEQ ID NO: 129 - protein, 165 aa, Debaryomyces hansenii
MPPKLSKTSKTNQITIIKFKRNKSTYVLPLDLNAKASLSIANFKSSLARAVEQSGGLSLVEEDEETNKLDNDDIEVPKSEYIDNVENDGMVDDNEEDTKNIIQDVKGDDLILALPKDKTSPYDNTWIEITDDSSISSLKFNDYDIIAFKHVDDDTFFISEAAYDE

SEQ ID NO: 130 - protein, 160 aa, Candida tenuis
MPPKLVDKRKQVTILKFKRGKSTYVVPIEFSTKSFQTLQNRLLDIINNSGGLTLSEDEPMMEDEDDIKVPKSEFIDEEEETGETDIKDAIMKDSPPPQTRIVKAGELAIGLPRDKTSPYSNDWVTVDDTILSTIEFNDYDILAFAVDGEPFNVVEAAYEE

SEQ ID NO: 131 - protein, 146 aa, Pichia stipitis
MVKKVLLINGPNLNLLGTREPEKYGTTSLKDIEQAAQNQATAKQDGSEVLVYQNNTEGFIIDRIHLAKQEGVGFIIINAGAYTHTSVGIRDALLGTAIPFIEVHITNVHQREPFRHQSYLSDKAVAVICGLGVYGYTASVEYALNY

SEQ ID NO: 132 - protein, 146 aa, Spathaspora passalidarum
MVKKVLLINGPNLNLLGTREPEKYGTTSLKDIENAAISQAALKNDGSEVLVYQNNTEGFIIDRIHQAKTEGVGFIVINAGAYTHTSVGIRDALLGTAIPFIEVHITNVHQREPFRHQSYLSDKAVAVICGLGVYGYTASIEYALNY

SEQ ID NO: 133 - protein, 146 aa, Candida albicans
MVKKVLLINGPNLNLLGTREPEKYGTTSLSDIEQAAIEQAKLKNNDSEVLAFQSNTEGFIIDRIHEAKRQGVGFVVINAGAYTHTSVGIRDALLGTAIPFIEVHITNVHQREPFRHQSYLSDKAVAVICGLGVYGYTAAIEYALNY

SEQ ID NO: 134 - protein, 146 aa, Candida tropicalis
MVKKVLLINGPNLNLLGTREPEKYGTTSLSDIEKAAIEQAQLKKNDSEVLTYQNNTEGFIIDRIHEARRQGVGFIVINAGAYTHTSVGIRDALLGTAIPFIEVHITNVHQREPFRHQSYLSDKAVAVICGLGVYGYTAAIEYALNY

SEQ ID NO: 135 - protein, 146 aa, Pichia guilliermondii
MVKKVLLINGPNLNLLGTREPEKYGTTSLKDIEQAGRDQADSKKDGSELQVFQSNTEGFIVDRIHKAKQDGVGFIVINAGAYTHTSVAIRDALLGTAIPFIEVHITNVHQREPFRHQSYLSDKAVAVVCGLGVYGYTASIEYALNY

SEQ ID NO: 136 - protein, 144 aa, Debaryomyces hansenii
MVKKILLINGPNLNLLGTREPEKYGTTTLKDIEQAAIEQAKAKGSEMAVYQNNTEGFIVDRIHEAKKQGVEYILINAGAYTHTSVAIRDALLAVAIPFIEIHITNVHSREEFRHKSYLSDTAVAVICGLGVYGYTAAIDFALNK

SEQ ID NO: 137 - protein, 149 aa, Candida tenuis
MVNKVLLINGPNLNLLGTREPEKYGTTSLTDIENAAVKQAQDKSDGSQVLVYQNNTEGFIIDRIQQARLEGVGFIVINAGAYTHTSVGIRDALLATAIPFIEVHITNIHQREPFRHHSYLSDKAIAVVAGLGVYGYTASIAYALNYQNQ

SEQ ID NO: 138 - protein, 145 aa, Candida lusitaniae
MVKKVLLINGPNLNLLGTREPEKYGTTTLKDIEMEAHQQVAKHQDAELFTYQNNTEGFIIDRIQEAKQQGVGFIIINAGAYTHTSVGIRDALLGTAIPFIEVHITNVHQREPFRHHSYLSDKAIAVIAGLGVYGYTAAIEYALNY

SEQ ID NO: 139 - protein, 302 aa, Pichia stipitis
MSSISRDVTLIVQSTSLSDFQKIKQLKSVVTISNVAELALPISEIDDSYNVILYLIRIELIIAHSEDYLKLPDLFRELLLVPYLKNINSSSVSPQNFKETYIKTTYNDNLTDYQYLIQNPNNRKLLDLINKKMLLVSNLPSTDETYHDLNRLINLKILELFIISSYDFRKKNILKHLQEDMKLDTDESSPVTELVDLLASGRVIPFDLWQKALSSDFGNNYYFLIRRCMNTSQLIVNWLENNIVLLSKYYISIKISKVYQLFHISSDIEVEQVILDMVVHKKLPTNSKIDQIEGILVFGQEE

SEQ ID NO: 140 - protein, 244 aa, Spathaspora passalidarum
MTTTNLLIDIINDSSIIDNIKVKQLSVQISQFNDVDIVSLNPSELPVDTSYKYIILLLKTEKILAQDPYNPILKQLVVDVNSIPPVAPNINENDFNSWFIKVKHNDLVTDIAYLITDLKYDNFIDLINKKLLNVKSVPTSNPYYSQLTVLIKLKILHLYLLSNYNFRNLNIAHYLQENLIAEEVSGDIWQLFENFKTNALISHDLFNLIVSANFNDNYQKIIEKMDKTKLYMNILENNIIRLNF

SEQ ID NO: 141 - protein, 348 aa, Candida albicans
MSTHNIILDIINDSSSSKIDQLNQLQNVITQLSKTELLELNVSSINIESFKLIVNLLKIESIMTNYPKEPLIKTLMEQDSAINATGITFLSPSTTTTDEEQYINTFIKAKLNDLQSDYQYLFKELQYDNFIDLINKKMLILNNLNNNGINISSLKDKLNLKILQLYLISNYDFRNDNILNHLINEIHQQQQQQENKYINEIEILRQVQSQPFVSYELFKTIIDHDFNNGYYQIINQLMKFDKLYHNIIENNIIKLTNYFTNIEIKTIYQLFELSPPPTSKTTSTTNNLPTIDIESMIFDMIIKNKFRNVTTIDQLNQTVSFNNDDNKNNNEDGIKYIGGLVNQAYMKI

SEQ ID NO: 142 - protein, 323 aa, Candida tropicalis
MTSKQILEIINDERINDKNKIECLYNILNQLTKSELLSIFPSSITSDFKYRYIIELIKIELLIINYNGEEEEGGKNIIGELISGINKKMIGYKHDLKDFKSWFIKIKLPDLQSDYQYLIKDLNYENFIDLINKKLLIINGIPKNESEFEDFIKRINLKILQLYLINCYDFRNGNILNYLNDNLKIDNYNHEIFEIINQTIINNPFVFKNSFEQIINYDFNNGYFKLIKNYMNIDNLYLNIIENNIIKLSNYFTLIKINTIYDILQIDENSIDLEAFIFQMIIKNKFNNEVKINQLEQTIDFNNKFEYSMEDHIKYIGKVINDV

SEQ ID NO: 143 - protein, 292 aa, Pichia guilliermondii
MDYTNIRTQAISSTNVANDPQWKLISRLVEAETVLANDENPDFDNHLKAIHADSNFPKTRHNENQLQWYMRILYYDLFTDYHSLFAPIVSTPKLLDLVSKKLTVITNVPDNISLDPQLYHALLDPIFVKMAHYVILADGDFRRQGIIARLKELMPPMDPITSKCLQLVGERKFVPLDLWSHAMEVFDAPITRRLIKSHRSVLRYNHIETNISCLPRYYDNITIEKLPQLFNEDIANLESVVNSMIVSGKLPDGTRIDQLQNIIEFRDSRPASTNAKSARVCKMVDAITRMIE

SEQ ID NO: 144 - protein, 351 aa, Debaryomyces hansenii
MSSIMLSNEVTETLNNRSIPNIDKYLYLRQIIYKNTESEANQLVDNLPLDSEDDELAALMILLKIEFILEFRELDIYEVDSLNKMVLLSSAFPKGPFNVQNNPTRQYIRVKYNDLYNDFQYLFNPTVTIFRFMELVNKKLTTLSNIPDTEDDNVIDLAVDLYLKVVDYCFLAGSDFRKKNILKFLDETLGISQATSVDSTIANRFNKKVDDSIRGIFTLLNEEKFILFTQYETFLTNSKAPIVKKIAKTNSSLLVSNFLENNISLLPKYYMNIHLDKITQLFIIPTDLDIEGLVSQMIINGKLPPGTCIDQMEQTIIFGEFQPEYNNFDTHVQEVSEMVDEIANLIHNTNI

SEQ ID NO: 145 - protein, 316 aa, Candida tenuis
MSVLEAISSSATEVEKFNRIKLISKALSHEELVNEVCTLSEAGLPDLDTDLWNCALSLCIIENKLESNELDSVGSLLSDVGTVINKHQGLTQDMPHLFKIVKFKHVDLNSDYQILFNVISKNYKLVELVNKKIVLLTIKDYSGIDKSFKEELVSKTIDLLIVSPYDFRKVDLVKFISSYVNEHGLDVKLSPLTEELFLMLTTNNIVNIEKFRKYTEQAPTKVIQHLDARQISANLVENSLFVLSNFYKSIYFSKLSKLLGVEVDHIVISKMIVNNNLPLNTKIDQVNEVLTFPDSTTNTFVETLNMVQHISNKLSI

SEQ ID NO: 146 - protein, 322 aa, Candida lusitaniae
MFDESARQNIEGKDAADLLEENQKIIFGVTQGSHNLDSLIAQLPSNDSSLAKKVADNLLRVELLLFYSIGPVDHSSIQSSLKCLESLLSEPEVDDNSNALFKVKYHDLLTDYQFCFTDSTKRLRLVDLINKKLNFLKSICGNEPLVHDIQLKILLLYILSEADLRKRNIYQYLKEEGVFSRGYPVPIREYVLLSTGNRLMSISAFNILTEHLSAHFPFFKHLLERHHVQLLEYYLENNIQRLPRYFKSIRLVKIPMLLCYKQEEVDIEDLVFRMIVGKQLPEGTRIDQLQEMVFFGPKVEKYDSMNTRMKRVCEMVDSLAIH

SEQ ID NO: 147 - protein, 81 aa, Pichia stipitis
MAGTLRPDPEFQRFNLAKENLGNYFRFKPRSAVFNVVFMGLVPLGLTIAAYNLEGQVGFFRKFRKEKILGGDDYVPRDKDL

SEQ ID NO: 148 - protein, 80 aa, Spathaspora passalidarum
MAKTLIPDIEFEKFNKLKETQGTRFRLTPRNSVTILIFAGLIPAGLTYFAYATEGKFHWNRLYRKGPLNQVNYVPRDKDL

SEQ ID NO: 149 - protein, 81 aa, Debaryomyces hansenii
MAGTLKPDPAFQRFNAAKESFGTYFRFTPKSIAFNLLMMGAVPAGLAYYAYSSDGQSPLRRLYRTSPILGGEEYVPRDKDL

SEQ ID NO: 150 - protein, 80 aa, Candida tenuis
MAGTLRPDRELQRFNTAKENAGNYFRFKPKSIIFNVLMMGIVPFGLAYYAYGSEGKVNFYRRFRKEPVLYKEYVPRDKDL

SEQ ID NO: 151 - protein, 618 aa, Pichia stipitis
MSVPQPPFKVKTKVSWAGEEDGDLGFLENEIIEVYSIVDESWWSGKLRRNRAEGIFPKDYVEVIPELNKSVSSHSIGTPKAQTPVQTPIQTPVKEADYGKFKHSRASGTPTGMYNSYNGSKSVSPKRYHHVNVDADGSFEVEDAVNCTYDGIYDSSNGMSLSNRSSPKKIRSANKLVSSTQHPRYRNSHNGYQQQQHEDFDREREMENFRTLQQQQNYHIKKLPLHNMKSLVQTQQQEFRQSSYSPENSNSIYGKHQGKSNSRSGSQQNLSQSAVQGHPPQVKSQSYVDIPYRNQQNNTVESFVSEGSPSRQARRARYDADAVNEYEIISQKRAQLELELLQLKQLERSTQKKRVHNPHLQHKLGQVSRGSNDDSLVNSLESSYISEDLLSSKKNYSSREDLGKKLAKFESVDDEDDDYFNDNESSPPPPPPKHTTPIKAIEAIRDNDSPLRKSGNKVPFDADDFRFSGSNRLHQGQVSEEDVYRVSQLQQDDLKNSIKSLQSDVLNLSELSATSAGSFMRHKYERDIQQQEMKLHSLSINEEEEKRSPKQNGKDVMDSVFQEKKSRHPNIFKMLLLKKSDNEINVIERKLQKDEEIDWTTFKMDLNQPEEWSEKRAR

SEQ ID NO: 152 - protein, 102 aa, Spathaspora passalidarum
MAKTDSKEAFDAVFQDKKSKHPKIFKMLMRKSQTEPALNPIERNLKQQDEMDWADFKISMNRMNSLTSEDKQSRTKRVVREEGNLIVKPLDYVTEINTNETI

SEQ ID NO: 153 - protein, 291 aa, Candida albicans
MENEIVQVFSIVDESWWSGKLRRNGAEGIFPKDYVTILEDKLNHSMSSLSLQDGRTTPTKQMDDHSRRSAGTTPLGNFSKLKTSQSFANDSIEYDQDHSFNQSFDDRYSKPFTPTKGNVRSSKYMSSAMNHPKNKLTYQQQEELLRKKEKEIEYFRSMQQQQNYQVKPKVNDSKRLSFQHTHHSSPDVASRLHQMDYTSPTSIKSPSYGDVPHSQNGKYQHLLNNYVATSDSTPTKTSKRATMASYEPEFLDEFDEIAKKKAQLEIELERLKQLEKLSKKAAIRSPIQKDS

SEQ ID NO: 154 - protein, 502 aa, Pichia stipitis
MHGPTSVHNFLDKRHLVTFHLGWSTAIVCLGTLQFGYHLAELNAPVDILSCKFHKPGPQPSYKHTFWGHNDFKQCIPMSEEGIALITTMFTVGGLVSSSILGSTSISSTYGRKHTCQFNAICYFIGSTIMMLANSALMLNVGRFLNGIAAGSALIMSPILINELAPVNRRGLLGSLLQLAVTVGIFLAQVVSYFFSNDQQWRVIFAFAAGMGLLQFALLFSVSESPKWMVVQVGDHRSATDILHALRSDRTTVDYEINHWRQLSSRTNLTQSPSETSALLSGSSITTREFMFARKYRDQFLAIVVIMTSQQLVGMNAIVYYGVRILNNLFGNHSSGTDYVLVLSCSFSFCNVLSAIGISPFVDRIGRKTLLLSSILMCGICSLVIAVGIINHYDVAVVTACFGFIIGFSIGLGPIPFLMISELADHEVVGIAQSIGTCTNWIANILIAYSFPILQNTMGGSVFFIFVAISVIYLWATWFYVPETRNFKTPKDVWVAFTGTYL

SEQ ID NO: 155 - protein, 516 aa, Spathaspora passalidarum
MHPPTTIHNFIEKRHSITFKLAWSTFIICLCALQFGYHLAELNAPGDVLSCHFHKPGPADSYNDTIWYQFGRNQCIPMSEQGVAYITTSFTVGGLLVSVLLGSTSISMDYGRKPLLLGSSSFFVLGSLLMILANNIWIMNLGRLFNGIGCGSALTISPILINELTPINHRGLMGAIMQIAVSVGIFLAQLVSYFFSNDQQWRIVFVFAFGIALVQLVGLFTIPESPKWLILNNADVVTATEILTELRTDHSTIEHEIEHWKHLTFGPIKETSEVSPLLQRHNSTVSVCSSVSSRQSLEPPAVTIYDFIFTRKYRHQFIAVVLIMTGQQLSGMNAITYYGVKILNTVFNHHGSGGGNRVLVLTCAFSVVNMISSTVVAPLIDRIGRKPLLLASVATCGICSLVLAIGIPNKYDIAVITACYGFIIGFAIGLGPIPFLMISELTGHEVVSLAQSFGTVTNWTSNMIIAFMFPLLQNLIGGVVFYIFSVICLVYFVAFWFKIPETKGIHHVVEVWRDYD

SEQ ID NO: 156 - protein, 503 aa, Candida albicans
MPNPTSIHNFLDKRHSITPLLGWSTFIICLSALQFGYHLAELNAPADVLSCNVKKPGPLPSYNNTIWSHFHFNQCINMTEQGVTLITTMFTIGGLLASIILGTTSISTNYGRKHLCVVAALFYVSGSFLMSFSQTNWQINLGRLLNGFGAGSSLIVSPILINELAPLNHRGLLGSLMQSAVSIGIFIAQIVSYFYSNDQQWRLIFLVAGLIGSVQFVGLLTVPESPKWLTMAKNDVERATLILKGFRTDESTVDYEIRHWGNLTTSNLPDDETSSLLSDDSLSSQNPPSIPTKDFIMERKYRKQLIAVVLIMTGQQLVGINAITYYGVKILNELFSGSNTGNLVLMLNCVFSGMNVAASIAVAPLIDRWGRKPLLMTSITMCAICTSILAIGIPNRYDIAVVTACIGFVTGWALGLGPLPFLMISEFTGHDVVATAQSLGTVMNWSSNMFIAMLFPFLTNILGIGMVFWVFVINSLVYGFGFYHYVPETKGFTHSRDVWEHFS

SEQ ID NO: 157 - protein, 507 aa, Candida tropicalis
MNPATSIHNFLDKRHSITFTLAWSTFFICLSALQFGYHLAELNAPGEILSCNFKKPGPLPSYDDTIWSHLNFRQCIKMPDYGVALVTTMFTIGGLLASIVLGFTSVCSIYGRKQLCTVAALFYFLGSSLMSFSQTNWQINLGRLLSGVGAGSSLIMSPILINELAPHNHRGLLGSLMQFAVSLGILLAQVVSYFYSDDQQWRIIFIVAGCLGLIQFLGLFTVPESPKWLIMKYSDVQQATLILESLRTDHTTVEFEIQHWKHLLTNNLVQQDEEQTETSSLLSHESQSSFDPPSISTWKFLSDLKYRNQLIAVVLIMTGQQWSGVNTITYYGVQVLNGIFNNPDGNMVLFLSCLISTVNVLVSVGVAPLIDKWGRKPLLMSSVVICGVSALSLAIGIPTKNDAVVVTAFFSFIIGFGIGLGPIPFLMISEFTGHDVVTIAQSFGTVMNWCSNMSVAMFFPILTKLLGGGLVFSVFAINCLLYGIGFYYNIPETKGFNHSNDVWENFK

SEQ ID NO: 158 - protein, 475 aa, Pichia guilliermondii
MGHDCSWIRNFSVWLPFGTYFICMNFSPPALTKAELNAPEDIITCAITRHGPLPHYSDTFWAHHGRETCIDMGHMGVAMMTTMFTVGGFVASILAGSSYVSANVGRRSMCMLSSSMYVVGSALIMWANSLLAICIGRFIAGLGAGSSLVMGPLLISELTPPNHRGLLGSLVQLAVAIGILSAQLVSYVFANNQQWRLIFFVATIMGLVQFVALFTTHESPKWMVMNTGDVHGATSILHDLRSTRSRAQRELKHYRRLSKVVDDEEATTEQSPLVASREPTTSESGSSQVANAEEPTEPVHATPFEFMTSSEYWPQFRAVALLLTGQQLCGMNGITFYGVSFLSPIFKDPLMIACSISLCNVICAIAVSPVVDRWGRKPLVLLSVVTMSICAFAIAIGMQFQIEAVVAIACFGFVAGYSAGMAPIPFLMISELAHHESVGAAQAVGGALNWLANISLAYFFPLVEAKLGGCIFYGF

SEQ ID NO: 159 - protein, 504 aa, Debaryomyces hansenii
MAESSNHRITFQLGWSTAIACSSTLQFGFHLAELNAPESVITCASHKAGPLPSYSDTFWYKHGFESCIPMANGIAMTTTIFTIGGLVSSIILGSNKVSTNFGRKSICITNSVFYFIGSLLMALSNSAMQMNIGRFLNGIGSGLSLVISPILINELTPINHRGFLGSSLQLAVVLGILLAQVVSFNWSNEQQWRYIFLFASGIAVFQFFMLFTTVESPKWLVLNQGDVHNATSILHDLRTDKSKVKHEINHWRRLSATVEDADHEPVESTSLLRCRDSIPLNSPASENGSLECGHITTGEFLTRKEHRRELLAVTTVMTAQQLCGMNALTFYGVSILSNVVPEGTNVLILTCSLSFCNVLSAFIAAPLIDKFARKSLLLTSIGGMGLSSLAIAFGLVHGYDILATVSCFVFIISFSVGLGPIPFIITPEFTAHDSVGPALSVGAAMNWSTNILLAYLFPIAQNYIGGNVFYIFFLISMAYIVCVLQLVPETLGYDAHGMIWNNFA

SEQ ID NO: 160 - protein, 515 aa, Candida tenuis
MTLNRQASFAYLKTRHSVTFHLGWATAVACLGTLQFGYHLSELNATQLVLSCNQHFDGPYNSYEDTIWSKLGLKECLPIEESRLSIMTTMFTFGGLVASILLGSHTLSSSIGRKVNCIINAGLFFSGSLLMAFANSLTVLNVGKFLCGLAAGSSVVISPILVNELTPVNHRGFLGSFLQLSLALGILFSQCLSVWFANDQQWRMIFLVSAGIGFIQFMLLFTISESPKWLITIKNDTRGATNILTNLRSDKNVIHDEINHWRRLSVHKTPEDLESTPLLEDLSGDFTPLTPSRSRRGSIDPSSLSLYAFLTNKVYRKELWATMIIMSGNQLCGMNAITFYGVIFLRNAVPKGTRVLYLTSGLALCNVLAALLAVPLFNRFGRKPLLLFSCLVMTLTTLSISIGLVNGFNYFTAAACLVFILGYSCGIGPLVYMMVPEFTNHNAIAKAQSFGTVLNWLANIAIAYFFPLLRGVFGGKVFLIFTTINITYFILIILFVPETKSLHNYKDVWNRFKYF

SEQ ID NO: 161 - protein, 524 aa, Candida lusitaniae
MHESLYTSHRITPHLAWTTALSCLGTLQFGYHLAVLNAPQQILSCQMHIPGPFPSYSDTFWGRHGFDQCISLDSQDIAWMNTMFTVGGLLSSTIAGSHTVASICGRRNMQILCAGLYAGGSVIFALSNSFGTLNAGRFLSGLGAGASMVVSPVFISEISPFNHRGLMGSLLQFGVAIGILLAQLIALLWGNDQQWRMLFVFGTLMALFQFVFLFSTVESPKWLIMHRGEISRASDILQSLRSNVRATKYEIHHWRRLSTTQTGKAQETSSLLEDPVNQETQTNVGDEDSQPEDGFYPLSTAMSRRGSIDPSTLSLQEYFTSRRYRREIIATAIIMTAQQLCGMNAITFYGVSVLSNIVPNGTNVLLLTCSLALCNVVSALAISPFIDRWNRKSLLLLSVSTMAFCSVLIAGGIVNGLDILAAVACFGFIIGFSIGLCQIPFLMVSEFCNHETISKSQSFGTMLNWLANIAIACMFPLLRSYLGGYTFLLFTVIGIFYLFAIVWWVPETKGKLNYADIWNKDELP

SEQ ID NO: 162 - protein, 633 aa, Pichia stipitis
MAPRRTPLHSDSLSLSRCKRAVRPFISKVHSLYDLNQKYSSLLVHNFPLKEALSCFRPDSTAYSENEQSRKAYNEIKGDKRRKKADYIVPKSNIGIDSDNLDYSYEETDSEERASVSPIMQSTLLSRQVDAFVSPKDSFARLLSMKPFITVELYDSYVEVFQIFRNIVTSFILSNHPLDQNSSKIPRLSTLSSLKIGKMIALSTKSSFYKLNQALLFDPNTLPIYLKEVHNNLNDDIDYWFEVEPTIVIESYRLEFILGYFVHLVVFYLKLVLYCLMPVLIHWLFEQAQTDGPNSQVLFTIMNTMFSEYWSITSQDHSDIDCDTTVLLNGNDFRRTNTRSFWILFKIGYWSKFVHALGLQSNFSSSCNSSLILETMPVDDKINLEVINEIDSDLSERETLIHDIYGVIKANPQHPILNSVLVKLFTELLSETRSRVGRCTNIEDIEESLSDSYLQLNDFLNIWLGLSNESSLIFNSLYPGNELIFEATSMLLSFIKSKATRTHNRLVRLIDGPYSVDAEKVNQLVTDINTICKNSDMLMKCVDILRGYFLDNGKFTPYFPYSENEISRTILQILLCESCYASNRELNDFLLWLYERGELALLELAQSIFKRAYDDHDEFDDDDIEEIGCLLFP

SEQ ID NO: 163 - protein, 237 aa, Spathaspora passalidarum
MSKQKYTLREDITIDTEELEEEIVEHDYSDKFSFKGLSSFISQELFLEYCEIFTIVKAIFNSLMVSDTFPSLSTLCSHVIGKEITKTTKTTFFKMNQTLLFDPETLPLSIRQYHHTLNDDIDGWFHLEPEDVYGKHRHDFYLGYLIHLLCVHKNVLYMLIPMVIQWLREEGYDYIAQAMNYAFWQDTDVDLEVLNGNFLNKLGPFWQLYNIGYWNKFLNANQLLSILHSKFTTPGSS

SEQ ID NO: 164 - protein, 461 aa, Candida albicans
MANKISTIRYKRQIRPLLSKIHTLNDLYSKNPSLFEFDISKIDINKPIKSPDADYHPRKRTKTVLLEESLEPDFYNPRTPEERLKSLKHYVSSELFKAYTELLSILKPVLISLAPSDCSWTLATRCAFEIGKEMAESTTTTYYRLNNVHLFDPDLVNPSIKELYDELYGDIDDWIDMEPAQVTNNYRQYLLIGYVSKLLVIHSQTTLYIFLPVLLHWLSHQNPYLRHLGQLLANDFFSFPDNSTTNIEELNGLKFNNTSRIFWTLYGVDYWKPFLNRASLSVVLPYKISLELFDELEGTHQLPKGYYRRELYSMFQICLNYNIIVMIMVKILQKTRKKCKTYEDAYQHFKNIYTLAVEMACNWLPFYSITFPNNKIIFNSLRQLQEFMQGKLKVLSSQGGKYTLLYKRSQGFFESLEAISYYYLYPDRKIILNSVDTVAKTAVKLRIDNHKFLAWLNRNAF

SEQ ID NO: 165 - protein, 471 aa, Candida tropicalis
MSDQLSTTRFRRVLRPLLSKIHALNDLYSKNPLVFDFDISKINKDCKSNKHLNETTPHSNHKQQRLHTTKRPKLGEEPIPDFYNPINSDDRLRSLRPFITPELYKSYTDLFHIVKSILLLLAPKQEHKWKLSSRCAFEIGKEMAESTRTTYYRLNNVSLFDPSSVNESIKELNQELYEDLDDWMKVEMEPMSITVNYTRELFAGYIIRLIVIHSQTTLYMFVPVLMHWLLMQGTFLRKLGSFLSYEYFTFPDISTTNVEKLNGLSFNDTILVFWSLYVVNYWAPFMNQQLLSEIIPYKISLDLFEELEVVHELSSGYFREQVYGVYQYEKNTNVIAMMMVRILQKTRKKLTSYDEAYIHFKEIYKLLLEVVRHWLPYYNRGFNNNKVVFNSIKRLRQYSEEKLSILSQQGGQYMKLYVNYKGLLDTVDTIGQYCIYPETKSKIDSVDKTAKIAVKLGFDSEDFLYWLYENN

SEQ ID NO: 166 - protein, 245 aa, Pichia guilliermondii
MTSRKTRDSDPIDLARCKRIVRPLQSKIHQLNELLTSFPSKTNLQYETPHKSFLHPKTSTQRLASLKPYLDPDLYQSYLDIFQIFQGVVRNVEVKRPNRVPRLSMLCCVNLGKSITLSTRSTYYKLNQSSLFDPETLPGHLHRIYHSLHETIDPWLELEPVQLYGGYRRDLLMGYVIHLIVFNSGMLYMLVPVLVQWLQEESREHSNGPLMAFSTILFNQYWHFDETYHPDFDSDFLGYLDANKK

SEQ ID NO: 167 - protein, 692 aa, Debaryomyces hansenii
MFKKSSPEYYENLTISKCKRIVRPLVSKIHALNDLNGKYPSILDFNFPLDDTCLQGLLSKKNINHDYSGKHIVNQLGQPRNKIRKLEDRKYTKCYDSDSDYDEGYDSLERRSMNKDYLPEEREHISNINKLIEPSSSFERLTSLKPYISGQLFQSYYDMFLIFRNIMNLLVFTTHKNNESTSSMPKLSSLCSFKIGKFMALSTKPTYYEMNQSLLFDPNTIPYHLREYQDILSDDIDEWLEMKPEVVTYTHRIDLLIGYVIHLLVINLDLTLYLLIPILIHWLNEELKRTGNTMLQSISRSFFLEYWTYGPDYSESSGFDNIVSILNGTQNRERNLNIFWIFHKIGYWRILISSFDSESTVTGSDTYEILTLDTISLNNKLSLQVLINLNAAYDTHDTHDFLHEIYQIIKKNPQHPQVNNILILIITQLISSTRLNIKQCMVSRDILNCFQFAYDNVIFFVHIWLSLPVKEEFLVFNSLYPGNTEIFHALISFTDFQVRQCDILFLNQSESTFFSKINMDGSSTIDLRMIRDNLSILNRTLELLKLYYLDTFDDFTIDPHSVEEISSFVLLIQNSKLNPSNVKEFTICNNSYNDLLIWLFDQQDPTLLQISQLCFRKYYGNRTWFKDVLIDNLYCILFEADTITSSSSEEIDDSRLDNSDGDIDDDDDDDDDDDDDDDDDDNDTEIQSSSLI

SEQ ID NO: 168 - protein, 500 aa, Candida tenuis
MSTNTNPWSVSRCKRVVRPLVARIHSLTDTVVKNPSLLHISSTPTSNTGINILAGMVKPATAAARLQALQPFVSPELYSYLLDIFHIFKSIVTSLETGSNPAPFIDPLGSKCSYEIGKAMVLSTRASYYKLNNSILFDPKSLPESTRKYHHSLSSDIDPWLQLQPSSIFEPLRLDILRGYLLHVIVFNSPRLLYLLVPTLIHWLYEESIVMGSSRLKSMSNKLFYEFWHFDSANYYDNIGDKAVKQLSRIDGDSNDLFWWLNSIGYWDNMISSIGMTSSQIGHNQYEVLILDTLILNNKLMDGGDDSEVYALLRRNSTHLQVNNILITMLTRLIKQSSYNPNQLNETYYGFLRLIQSWLAFGSETPGLFNSLQTGNDAMFKGVISFSRYLHKSLSKSDDLTKLLILLFHYYTNRQPGIQLIGLDAHHRVLLKTLRMIQMEELKKFIPLKYSNYEISSFIYWLLDNKLGKFASAVFYDYYGQFSKYYDDDLRHIHRLIKKA

SEQ ID NO: 169 - protein, 516 aa, Candida lusitaniae
MKKPRPEALPIAKCKRIVRPLLAKIHVLSDLYQKYPSKFDFDVAQFTKDARKNTREKKSLESAASHLASLKPYLSSELHRAYTEIFAIFRNIYTSLYGSSVPEKRLSKLSTLAAAKLGETVALGTKSSFYRLSQARLFDADTIPANLRRFHSELANDIEEWLDIDPEQVTGRYRNHIVAGYVVHVLVFSSQPVLFMLLPVLALYLHEQGDNTLSRLLFHEFWSFSPQDVHVKLGVQGPDSSKALIWSLHSSGYWERLISHLGVASSWKSVNIYDGMLLDGMASCVKVENAPKGLVLELLGRNPQNPNNPAILMGLFADIIHLTKQGLRNSSTSHKTLETLTSAYSDTRNFVQEWLPLNRKAIFNSQDKGNRQLFEAIKSLLRYILGRATGAIAYLNKVVDSNSSRKAQEMLRRFKFLYYHVDLMSVVTGLFEAYYLCLNEPPTLEGSKQTAVAEFLVDLVQARAEDQEVAAFLVWMAKADSKELSELSRKCASQLYDDEWSGRDLKRAYRLLHGNK

SEQ ID NO: 170 - protein, 152 aa, Pichia stipitis
MDYGTVELYHEFLNQMESCEFNNSLINLATSPSPESFTPPIPSTRHLASIAPQQLLNLNLHLDVNTYYNKLTGLICQIPFHGSAADKDLFQSLAHNVTQSRTQKSFQETFAEDEEDEMNPLAPGLFPKLNIGDDEKFMKFDTLPLTPSYVAK

SEQ ID NO: 171 - protein, 183 aa, Spathaspora passalidarum
MDQFLPVQSYNAFFTSMQSCSPDILQVEDPQPLHKPCNQILFPVESKSPQNTPEFQSLFLDQPFHESNYYGEMLERSCPEQLLEKSDQQGLFPNASTNYDALSFNHEPQHMQEQIKNDEPVQIQWSSSDSSPSLSQQTTIDSDDYSDSENPVVPGLFPTMNIDDDSQFMKTDSLPLTPSYICQ

SEQ ID NO: 172 - protein, 236 aa, Candida albicans
MSYNPESFKEHTNFQSVHSFLNSFQSKDFNDSIIQLEAPSIDASREVSTSPTNSKGSTRLNFDPKQYYHHLEQLPQAQPQLQQQFTEQFQILNLNKDLCERNTATRTNKKKLRASGNILTADQISRTSCTSPALMSPVFTNDLLSPSPELDLLEFEEDDDDDEEDDEEALFDGDYNENGNRVNRWNQDDIFQSHDNANENSNPAAHGLFPRMDLSAHNNFMDIKELPLDPVAHKRQ

SEQ ID NO: 173 - protein, 266 aa, Candida tropicalis
MTKKKKQLTKTTQLSNQKRYKRYKLELFLLLFILTYNSWILFIMPYEDNFKENTKFHSAHYFLNQFQSKDYDDSIIQLDGPSTNSTTSTSTTPVDPGLITVPIPSSSTSSTNNKRLDINSPEPLQQQHHHHQQSVLTLNTDLNEYMRGINKNKKKISNSVKDTPLSRTASTSPCLISPVFTNNESNTSPELELLEFEEDDDDDEEEEDDDDENEHWDQDEIFQMHGDGFSINPTVPGLFPQMDIGTNNEFMNRDKLPIEPMVHKRQ

SEQ ID NO: 174 - protein, 145 aa, Debaryomyces hansenii
MDNTVELYHEFLNLMESTNYHDDLITITAEEPPLPYTNLPLNLNLHLNINSYYDKLTGTCDCTFDSKLYFISNGYDECPGLQMHVEENRMYTGIEFDVEENDELLSETECDNPVAPGLFPTMNVDNELQFMKFDKLPIVPSYISK

SEQ ID NO: 175 - protein, 236 aa, Candida tenuis
MYANINTANAVFCRYMESFSEEALQPVESYNEFLEWMEQRDYGGNRVVVCTSGLTSAPQPHTAYLPTPYSRSYPPSGTRFMTGNPGSSNRIGSPSNNGPPISGGAKFYSLQIDLHSAPANEAHQIDWKKQIEQIDLEHIDLDDLDGLMVDDDDEDEDEVAWRLDTEEFPHIGLFPTLTPREEMEDEQEQEQAFLDSHQQTQSNPVAPGLFPQMDLSDESQFSSLDMLPLNPSYIMP

SEQ ID NO: 176 - protein, 227 aa, Pichia stipitis
MYFQTANIILGFLSIFATAYNHFSVDESPILRITSKNYDRHLISQALQKAYEDVFALTPNNHALLHLSSNSKINTERECIEKTVISYYLRDLKFITKEFEASECRVNTNNKYKSILQPTSNIHHLFHSSLDNIQIQLEASLMDEIQKLKTLGDIEFNQFDSLDYSLECLIGFQELAQVKMEETDIQTTLEKVIQIPAACGFQKIQSSFEGIHYETVKIDLPVNGTFY

SEQ ID NO: 177 - protein, 247 aa, Spathaspora passalidarum
MFKIVLVIILLITSVSGVLPDHNEVDRSILKVSTRTHDKHLIIQTLQDVADKITLRPDNSARFQLWNGEDDRTCIEGSSIKYYISKIELTDKNLEASECRINLNANFQAVLEPTPNIHLLFLSNKDAIDTQLKINLLDEFSLYSQFKEYKFNDFGNLNYDLQCVIDYQEIMQVQFKETIIEVTLERKIDVHESCGFNQLNNQFPGYYKDSDIVQLPVNGTFYCHRGKSSTCNRAIAEYKGSRYKLPD

SEQ ID NO: 178 - protein, 253 aa, Candida albicans
MIIVWLIFSLFTSLCLSVSPDPNPSKIDRPILKISTRTHDKLIIINNLQEIANNISVGMTSYEKFNRLSSNEMRECVEGSCIKFYIREIKCTDRTFIASECRTNLNARFQSILQPTTNIHNLILRDEDSLDTQLKTNLVDHFSSFRQFKEFKFNDFNNNLNYDLQCLVDYQSLMQVHFKQTVVEVNLMRTTEVADACQFDKINPNFDGSRSVYTTTYLPVNGTFYCQKGKSQTCNRTIAESKNSRYKLPDICG

SEQ ID NO: 179 - protein, 249 aa, Candida tropicalis
MLLLLLILILIQTAIGVLPDPNPSHLDKPILKVTTKTHDKTIMINTLQSVASNISVTAMSHVGVAKWSSTDMRQCIEGSNIKYYIRSIRLSDRDFIASECRTNINPRFQSILQPTNNIHNLILRDDNAIDSQLKANLMDEFGGYYQFKSIKFNDFQNNMNYDLQCVIDYQQLMQVKFKETVVEVNLEKRVEVSDDCHFDKLNPNFQGTSVDYVTTFLPVNGTFYCQKGKTYTCNRTIAETKNARFKLPD

SEQ ID NO: 180 - protein, 222 aa, Pichia guilliermondii
MRLNPHIIVVAGQLLLTISLKSHGRLTMLNIVHETYNTFITKPPLKLGAKEKSCLDNVSVNYVLKSANYSQVEHAASECRINMSSRFRAVISPTFNIHDVVHRHQDPVDAELSSIILQRSAEKGVILDPQFDDLDYGYECAIGYQDIAQVILVENVIHADIQTVVEIPPQCMFGNEENQIFIDKKLVDIPLNGTFSCRHGRSPTCKRNIAESSSPRYRLIEH

SEQ ID NO: 181 - protein, 254 aa, Candida tenuis
MNSKFLQLSVLLFSLFGTSVSFQWYLQEHPILVVNALRYDKSIIFQRLQNSFEKMYHLPDYAHAKLYIGDKDTEKKCITGTEITFFVKGFEIVQKEYEASECRINLNPEYQVILSPTAGFSSFIHQYNDPLTKSVEMNLMKKFSGSKIPKIGEIKFYNFHALNSELECLVEYQEISQVKMKEWNLQVHVQEVIEVPESCGFQRFDKSFDGTFVEALEVNIPINGTFYCRNGRSSTCKKSTAEFSTPRYKLFRDQ

SEQ ID NO: 182 - protein, 600 aa, Pichia stipitis
MPISTGALENSLLSLYDYSLNFKVSIDLVQRLAHQLKLETFVDKLGYTVDAAHQTPGGGKTQRLTIAGTSILIDIDFVDDNDIVNVSLSLANHTSSLSSISEVKNPNSHIKSLTQDANGVTNLLIDPAKNPVSFFQQGTSGLASIAEEILLLNLRSKKLNSFPVNLKYLAGMDKLSSSSVDVFSFLERVALLLYTISSVQSTNDPRDWLLSEGYITSTGKIRINDDNKQQLGVFSDYWQDNRYINHENGDKTNLVGKNYNMLLKIVSSHRESKLDYFEENRTKVWDLHSPQGGYKPYRFDFDVTSNPDFLPGNNLSIELVLNHPVYLPVYLLEYLGLLDYKKKKTGTIVDEMFETLNTGDEIVNKVILESNSEILFKIAHNFTSNNVAPIKSVVINQLTDLAILIPNFRNFLVLANIYRSLCDVKSQLEILPGGIKSPSNSIEKELTEEAKKKLKESLKLPDDVTDEELLSLNAISENATFSTIQPINREAETDLDSFFKNTPEEPAISVEEQNAEKEEYFQLSLDDIDSASPYYDLQMSLQAQSRLGDIWVKFKIANGVIVAAQDDSAMEVDSDDIKTRFIRALNLTEDVIKSIKYAYM

SEQ ID NO: 183 - protein, 568 aa, Spathaspora passalidarum
MVSFNQSLDTSLQLLYDYSSNFQISVELVQKLAQHLKLETFIDTSFQFGNVEGNNQQRLTIAASSILLDIDFENDRKVSNISLSIGNESTHTTENSKEYIESVQNNHGITVIKLNPNKNPLTFLKKSSDEKSIAEKILLANLSQPKLNKFPENLQYLAIIDKYANSNQDLFTYIERTALLLHTISQLEIERNPNNWQIEQGLNNAIGNVKIHDITQGKIGLFLEFWKDFRYINHESNTAIGNTYNVQFNIVSSSYNHEYLLENNKKEWEIANQGNKERVKFEFEDAVIPTVNNDGTNTTMLPWMFDLVLNHPIYVPKYILEYLGLDYTVEENTTDPLFKIFDKINNSQEVVDSINILGRNVSCLINHDLISNFIPLKSVKINHLYDLSSLIPILRNFIVLSNLYRTLSQNNCIIPRRKSRRRSSRVSFKNDKELTEEIRKKLKDSLKLPDDVTDEELLGLNAISETATYSTIQPINDMFDLESFIKNDQTTTSKENYFQVSLDDIDVTSNDLYLTVEAYSDIKEIYIRFKISNGQIQLLQDDIDENNAKFIKTLDLTEDFVVSITSVY

SEQ ID NO: 184 - protein, 618 aa, Candida albicans
MPGTKSALDKSLQLLYNYSTNFQVSIELIQKLAQQLKLETFIDSLGFNLDDSKPGQKTQKLSIAGSSILLDIDFETDNKIVGLSLSVNAGDSLEQQNNHREIGPPNHTTNGQSSSHISIVTDELGIHHVKLNCNNNPISFLNKPNDLNKTQVEQILLRNLQASKLGNFPVNLQRLATIDKFTNYNPDLFIYVESIALLFNTIFEIEQQSNSSNWEIENGLSSSIGKVNINNEDRLGVTLDFWQDYRFINHEYEIVKNQSGLLVGDYYTIQVDIVEASKQTDYLLDNQVQEWDISMSKYKFEFDSNSLKPLVLDGDGFLAWSLQFKLNHSVYLPVYILEYFSLALGNNYTLDTGDHNCCNVFAKINEGESFEQVLNIDSNSVSFQLTNDIPGKFVPLKSFHINKLVDISKLIPILRNFLVLINLCRTVIKSKSTQLPVFNSKRRRSSRFLGIPTTERELTEEFKHKLKESLKLPDDVTDEEILGLSAISETANYSTIPPANKDDIDLESFLGNEDTTNSGDVDTNGKRGTDHLPVNGNNYFSLKLESIDLSSRGDLQLAFESQFKSEEVYIPFRISNGEIVKLQNSDDMETDDTPSSKFIKALNLTEDIISSYKAVYSN

SEQ ID NO: 185 - protein, 602 aa, Candida tropicalis
MGSTFNSELDKSLQLLYAYSSNFQISVELIQRLAQQLKLETFIDNLGFQLQNSTNNTNVQKLTIAASSILLDLDFESDTKIVNLSLSINGSENLQTGEPYTIHKDELGLTHVKLNCNNNRVTFLNKSSNSNKTQVEEILLSNLQGPKLGNFPANLQYLAIIDKFANHNPELFIYIETISFLLNTINQIDKELEDWQPEFGILGNVKLNQDKKLGVVLDFWKDYRFINREYRSIKGTDELLVGQNYELKLNVVDSTNQVDYLIDNQIQEWEIAHGKYKFEFENTLKPLVVDGDNFSAWALQLELNHSVYLPVFVLEYLGFLDYTTSEAEQSLKDVFEKVNNGEEFEQVLNIDSNNVSFQFSNNIPSKFVNLKSVNINQLLDIPKIIPVLRNFIVLSNLIRTVINNKSTQVPIFNNKRRRSSRLLGIATSEKELTEEAKQKLKESLKLPDDVTDEEILGLSAISETANYSTIQPVNNKDEIDLDNFLQNEPNGNGSTSSNNNEMEGIKFSDSQSYFLMRIEDIEFSNKGEVQLIFEGNVDAEEILIHFKISNGEIQIVPNGTSTTNTTTTITSDDMETDDTPSSKFIKGLNLTEDIISSYKSAY

SEQ ID NO: 186 - protein, 563 aa, Pichia guilliermondii
MNVFNEGLEKCLWMLYKEADSFGASASLISRLAEMLNFDTFLDEDAYTHIVGEPLVDNNKERMKFKRLSIAGSLILLDIDILTDTKILRISLSSANHQGDAKVGNYYKIINSGDTSRIEVNFSQNNESFLGKSANPEKILLSSFADDKLGKFPRNLAYMADLDKSSGAGPDLFLYIDKLALVLKAIHEYEKERDATWESQNGYVGSVGRVALNNETDLLLGVFLHFWQDWRYINHHKAPESATPAFGKNYYALLRVKPSTSSNEYLNDSLKWPLPDGSKLDLEFANNDTKVDEDSSPWILCLEFNESIHLPLQIVELLEAVVADEGSTSSAAFTALNNHDSFHGNISLENGTFVDTRVVSDLPYRFIPAKVVEIKSLKVIPKLLSLARTFLFVQNLLVSFNEESYSCISSAATGLQNGGLNDDAKQKLIDTLQLPNDITDQELLGLNAVTDNSNFSHHMQPSENLDLESVMAEDAGESASIKKGLSVTFEEIDLTSLSLQITITGSIDDEGNTLEKQFSVSNGNAFLSQKGGDMEIDDAPMEKFVRALNVSEDIKRSFKYLLE

SEQ ID NO: 187 - protein, 621 aa, Debaryomyces hansenii
MSSFNDSLDDCLVTLYDYSSNFYINVELIQKLAQHLKLDTFVDKDAYSHIFEPTKSSERVKFQRLSIAGSFILIDIDFTEINKIIKVSLSLANHIDETNGNIPNFDLKSHVTIGEKDEQGNMLVEIDSTENKLTFLTKGNQEAEPSADDILLSSLQAEKLGKFPFNLKFLATLDRLSSTDEDLFLYLDKTAVILQTAYLLETKHNEDWLYTEGLYTSVGKISTNDPKSSQLGVFIDFWNDFRYINHEYTTSDSSTLLMGNSYKGFLNIKASNSTQKDYLLQNKESIWKLVGRDEVIESYKLAFNDGPQPKAPSTATSSIKSSNKNNSNWILSLDLNYPVFVHLQVLEFLGITDYEKSNEKIIDSDLFDKLNDSNEYNYNSGINKDSPSKLHITQQISQEYIPLTSVSLNSLTNLIQLIPLFRNYIVLANLLRTLIKETASNPFIFVGINGVSTRAGEMSTETKNRLKASLKLPDDVTDEELMGLSAVSDNSAFSTAQINKPNTVDLTSFMNDGLSEVEKPPASIEDLYILFSLDDIDYCSSTYDLLISIDGLLVNSKDELVDFEVKFKILNGVMSKIKPDDQEDVNMDDDNELIDKNEKFIKGLNVTEDIIKVLKYVYLDS

SEQ ID NO: 188 - protein, 562 aa, Candida tenuis
MSIELIQKLSQQLNLDTFIDTDAYSHIIDQPYHDESGNSIKFQRLSIAGSLILIDIDFLDSVIYRVSFSSANQLYDNKLSDINSSGAESNTKSPPTVYKQDNINVIKLTFAFDSVESILDKKEYNNIEVILLKSLQAPKLMNFPRNLKYLAKLDRLSNTHIDAFTYVDNAASILKAIYSLETQASVDWLIEAGYSNSIGKPCINKPWSNDVGIFLEFWEDFRYINHEYQQEGSGLLLGQKYSLLFDLDQSTRKSPTDFIGEARDHIWEFNGEKYQLQFGDNTYLTTGRSSITASTKNDTSFTSNWAFNLVLSHPIYLPINIIEFIGIESFEESDFKDDTFFDKLNVEKDFYVHSKVNKGLKFSIKSDIHSKFVSVRSLSIKTLRDIPLFIRIFRNQIVLTNILKQLIWSNGCKIGGEVEEEDKDFEAKSKLKNSLSLANLDDQLLSLHVLNKSKFTETEETDLDEFMNEESPFESDAEEGLVVKISEMSYNTKNLDTFIEIFGKFNDLTVDIHLKISNGEIVSNHINSVMDDEAITQYNRFIKCLNITEDIVKSLNHVYPPT

SEQ ID NO: 189 - protein, 368 aa, Candida lusitaniae
PLFWNHSSTIDESDAELVERASKYTSKQSEYTINVVFSQANSLSFLRTRNDSSTVAEAILLKNLSNNVLGNFPTNLKYLTCLDSMSPLDGDLIVYLDNIALYLNAVHAMETNLNPGITDIRSGWKSRFGKIYLNDPETQRLGVFLHFWKESRRLSEVMKHGATPCNSRVHKAILTIEEGESQSLDVLKEAKDQKWHLSTSQGLLQPYIFTFEDDSHLHNHQSVTSFSSPNWALHLRLDFPVFMPSVHIEYFGITNYGQAKKPREPEVFKSLKEDGAVQFLARRNGENISISFTSDDTAELVAVESFEITKLTQLEKIIPTIRNYIVFSSLVDNVMQSPDTTFVASPKSSRPISPKVKGFTKPFRRGYR

SEQ ID NO: 190 - protein, 241 aa, Pichia stipitis
SANSFIGKEWDKIASKMAVPLLELVLTYLPHLQYTEEARQDTWEIVAIKLSSFQFAQTKDERVQQILDIPILNGIFVEERYNKFMDSFIRQFFAFPGMDEEMAKKRMSSKEDFILFELYKMRGLGAETLAKLSKERFEEQQRALINSEMFTKRSYNITDGVYSEAIENTNSSEEVEDSSTEKGEPVTSTSVALAETRSQLLTKQLEILNRELEKLNKKIDLLEKENKTLLDLNHELVEEIQ

SEQ ID NO: 191 - protein, 230 aa, Spathaspora passalidarum
MGKSFYEKEQEKIRALIKIPLLELVLQFLPHLQPSQRQRDDTWEVVAIQLGQQRFSEAVHEKKSMEEVEAIPELNGFYIREMYEQLFANFKKEMQFRLAMQTAAVPNSSAGSPMRTLSFNPQDRAEALLFTLYQMQYWDVEMMAKVSQEKLEKSFRRYLEQQELGEKDKLEVPLPVVHQYRKSVELKKNEILKEEISKKDKRLEQLAQENKRLLELNHDLLSQLQGHNNP

SEQ ID NO: 192 - protein, 294 aa, Candida albicans
MGQSFYEKEQKKIKSTIKLPLLELVLKFLPHLQPTIQEKDDMWEIVAIELTNLQYSKILSLSSSSAATVTTAGTMASGGSKNEKSYSILQRTKLLAGQKPSSKVVEELESMPELNGIYVRDYYEELFNKFKSDFQFSIAMNRPDVLDGSRSGNPMMANIIKDRSDALLYELYRLEFKDIELISKLSQEHLENKLRKQLNKLYKIPNHDDKQQEGDEDDEEGRNGEYDAIFDSQELLEKYKTSSYNNKNQMLHDEITKKDKKLEQLKVENQRLLELNHELLEQMNGGNRNSIGQL

SEQ ID NO: 193 - protein, 273 aa, Candida tropicalis
MGQSFYEKEQKKIKSLIKEPLLELILKFLPHLQPTIQIKDDTWEIVAIELTNLRYSEILNSNNTNNNNKNGKSRTLSSSSSSLSSSGISIKKPVTSNVVDEIESMPQLNGIYVREYFEELYKEFKKVYYFQLSVNRSEALHGRPMNELGYVAKDRCDAILYELLKLEYKDVELMSKISQEKLEEKYRNQLDKLYNVSNEEENVVKDDINDEILESKELLEKYKQGSSIIKNQLLQDEIVKKDKKLQQLKDENQRLLELNHELLAGMNGTGQNS

SEQ ID NO: 194 - protein, 236 aa, Pichia guilliermondii
MGYFSKSFYKQQQDQIREELGEELLELTLRYLPHLRPQKQQNDYWELIAIKLNETLALKRIGERHDTGPRQSLDEISTINGPRVKEIYEYEMKQYVPSFHPRPAGSSQGADIAIYVPRGRKERIIHELKSLQNHDVEIITEISKNKLRESWEQHLENDFKDTQTSEDDEQDEEPKNKAGSLLEKARESSKEKLIESLIDQIASRDRKVDKLTREVKKLLDLNHALVGGEREEIGER

SEQ ID NO: 195 - protein, 271 aa, Debaryomyces hansenii
MKAFFNSGTSRNSFFKQEQERIESIIKEPLLEYVLQDLPHLQTTKEQQDDIWEMIAIKLNTDQFQSTLTSTDNNNKEVDEIATLNGPYIKDVYIKLMDDFMQRVYSINRYKQIYKAEYTRPPDGGPAPIGYAAFSLPIREILAERTDKLLCELFYLKGYDIEVMAKLSKERFEEQQRNEHKNKLAVANNLNQDQEPHKESLDNTSADDDKEKTHKALEQMKEQLGKLKLDFYEKEFVKKNKKLDQLNNENKRLLELNHELVIELQKLREKS

SEQ ID NO: 196 - protein, 251 aa, Candida tenuis
MKSIFGSKSFYEQERDKIKEDLKLPLLELVLEYLPHVQESIKEQEDSWELIAIKLNDHRFVDAIRGGTSSHPKGSKTKNNSREFNLSELPMLSGVFVKELFESIMREFEDGVPQYNWNHRIYRTRVVVPADGHQDGSIYYAFNFPVKEAYSQREDLICTELFYLKGIDVETKAKISKDKLIRRITEQESEKTLRIAEDLNQARISTNDKRLEACIEELKKKDLRIETLDRENKRLMELNQTLLEELNELRS

SEQ ID NO: 197 - protein, 703 aa, Pichia stipitis
MSDMRSVTEPSTPRHRISVVDTLGSNHSLPPINKADLLSSTIPYRSLDPPLFNLRNIHLPPNELTEATAKLSLQIQEQGSRPRSRPRSRPSTPGRRISGSHSRILSQNFNDRRTSDLLARRRRSSMIRTNTGAVVYGPHYVGPITIDYLRFICRVTVRQIERDKIRKESFQMHKPNSEIEIALLQTNLDLNGDQLNEPKSERDLSPETPQPRNIDFSPPRPNIPNEFDQSLPIPNDIEGILKSPIGYNNEQQASPPSRDPTRTNELEDLTYENKENVPNFLVEEKEEPRSKPLSYLEKILLANKKKRQSREESRQSSTRFSLSKSLGEETPQSPELFVAEDYDEDQHEPRITKDSEIKGDNFIVESEQMNALPEEVDQDEPQENFNMYDPDERFEDFEIRNVLKETTESLSSQMDRSTILGVAQLTPVRDMSYLGPSFSSGSQIVTPQQVRVIDFASGESPSGIIQDHFTLDNDEQFTDIFDVPQEIEKENIKEGTATSKQFDEGLPDLAMKKSKASSKNVSKRSIPISTIKSLVKTIQVHDSSSFDDTTTPSKKVKLSYISQDIFNLIQEKSDIFLTSMLEDLDAYSRHRANGKISLINLSDVILYLKRTNFTGLGPNKKMEIDKISQIAQKFLPLENLIALDNNLSKLDRRSHASIVENYNEELVQNLNESGNDGNESEEDVAYMLDSDILSQNYDDTYLP

SEQ ID NO: 198 - protein, 628 aa, Spathaspora passalidarum
MSDRSMSNPTTPRRARTSSDYVESTPIEQTRRHSFNPTNLRLPTHEMPQLPTRYSSEFRPRSRPRSNRSTPNRQSLTPVRRRSLTPRRTSLINSRNRRSSIVVIDGGEKVFMGDYRGPISNEFLLYFCKVDQKRKRQQEEIQQRREVDEPRRVPQDPFRVEQGELVRLSVYEPKQEQIQEPQSEQHPIHEQEHIFANNNIASTTPIRRFSRAPTSSPAEFDQSLPLPQQDHLLSPAVVTKIASTPQKSKPNPKPLSYLQKILLAKSKQAPPTELKSPLETRIEHDIPVHEDIIQRESPIIPDRTSFTIRQSLVPGVNLLESEFIPTTPAKEVPFEIHVDEPMHHRPMTEQQPQPPAFEDTSQEDKENHQAEAVENIQLPTNDMDQEQGFDFAIMDDDQEPIETEQDITSDHDLPTAEESQITPPPREETPPVPGSYFDTVTPPRTRSGSSSPAEFIHHEYSLDHHDESIFDEELASPSNVPTTLGDVPTVPRKQLPSMRAPSKPRKKSEIIPSSVNYSDMAHIVKTIQAQHVNGGKRRKRNPSSEIINSIREKADSFLDSLMTDLQAYAEHRSDYENVEINMSDVLLYLRRVNLTGESELDIISTLAQKFLPLESLISLDNDLYNYLQ

SEQ ID NO: 199 - protein, 756 aa, Candida albicans
MNGSVDLNNKSLSQPATPPRSSPNTTIDHSQSLPNSILRGSRRTSIYNIPLPPHGLSEATTFLSQQLQHQLSERGRSRSRHSTHNTTSNHGSVTPKSRRSVTPNSRMSLTPIRSRRNSRRRSSIIITKTGEKLYEPNYQGPITIDYLKFFCKTSIQNQDKINQQQQQQQQQQLGEPFVDTRDLVTSEETNDSRISETSKHVTQESTNVVSPFEKNESNSPLQIQEEFSQSLIIPSNNDNILESLDETKQDVNDVVLQEQHSHIDEMPQHDKDSPEKPKPLSYLQKILLAKSKKSSLISRKTSDETPTKEVVPKLDDLKQSEENDASTVDTGKQDSQFEQDNGEIIDKIDHFAIQDNSKISNSIFPDWRDNSESADASAGAATISNTSSNNVNTEGPSTDILNDLESAEDNQIFAAGDSIKDSEPDKDDQVPVTTSSTESNGQQTETVELAKSQSDELNTKENENEGSNEIDWNIQEPDFALMDDEVPSQEPTPTNEIEEMNEPHESSSHEDDITPPLTNTQEGGSLSMAKDQVTPENLFISDQQLVDEEASDASENEIIQDEFFVDNDQSASIFEGIDDDIEEDESTDNNDQEFGLEPGKSNRVHLTRIIPQKRKQSPVSSTGVDVSIRDVSYIVKSIQAHRSLNTTLPSRKKFKKPKSLSREIVKSIQEKSNEFLDTLMDDLKSYAEHRQSQTVDMKDVLLYLQRINFAGKGSSTNETEIDRISELAQKFLPLENLIALDNDLYDTISPQKKRQK

SEQ ID NO: 200 - protein, 731 aa, Candida tropicalis
MLSINRKPKQTISYKIRMDGLLEHNKNRSLSQPVTPKRKTATTSSSLSSVTSPEHSHSLPNSALRRTPIFNIHLPPRELFQQDTNVIPLQGERGRSRTKPSTPTNRTSLTPRRAKSLTPSIRSGSLTPRSRTSLTPMQSGRSSRRRSSIIVTNEGEKLYKSDYQGPITLDYLRFFCKASIQSEEMIKIKKQELTNPFIDKDTSTPEFNVVENIEEDTIEDIQLENAPSEQNTAENFNDSLQIPDDYEQLLASPQREASENEGDMSIEEETEHTPENSDVSSPIEIPIVKPRPLSFLQKILLSKQKQSSFLGSFDEDGNVPIKQEIEVKHNYVEVKEKDASIKEEEQQIKEEVVTVKEEKIHQTDPTASDRPIDQFTIQSDSQIDNQLFPAWTKPEKENTLGYSNKISSTLEPSIENTIQEGQFADDEFETKNEVLDDRANWEVPELESEHIVDDEISEQFQEEAEVIAPVNEDDSTSESKINSVHNMEDSNITPEEIAAVNDDSRQTPDVSTPSHLVSSNEQILPADSDSSADLFVRDDVEQENDEIIQEEFVLDDEGDDDVNESIFNEIINVNTSQQDEKPEFLSSERMLPKKRKMTSVPSGLDVNFRDVSYIVKSIQAQNFFESDMPPKKKTRKPKAFSKDIISSIQDKSNEFLDNLMDDLKSYAHHRGSNTVDMNDVLLYLQRTKFTGKSDTSDQEIDQISVLAQRFLPLEDLIALDNDLYDSVSLNK

SEQ ID NO: 201 - protein, 646 aa, Pichia guilliermondii
MEVSTPGRSVTEPSTPIRDSSPARLSSGSHTDPNRRSQGVRVPLPPHDIPRLSFSLAQEEARRAERRSRRSGRHQVNANEPTSRSRSRSRRNSLTLDPRSSGDFAQRVKRRRRSSLVEVDRSTKRIFNPGYVEPVTVDYLKFFCKVSIAEKNKLAEHQQPIIDSPPNRSRSRSSFLIHYSDQNPEIDEFNNSLPLPSDTHPLLSPVIRSDPDNVYEHDTPYDNHDLKPAPPSKPKSFSYLERILASQGQKKQEAPAYTFGPQSFKTPASKAPKSPVDQTSPFIIDDKGIESTHESPLPDMPVEQETTPQPISNAPVTATPPYLSEDPNGQDELPGETEIGKTDLADGIEEANFEIPNDLDTQQEHDNSTESPQVPSFGNTLAKDMLSPPTASSVHTPSIDGTPERTFQDVLGFSPSIIQEEYTLMDAVNVPDIIEPDSDDENPHEPPSRNSPSPSPARESSSERSPTTLSHRTRIPHALLSLPDQEVSTVSSFPIAMIRKMVKSSQTSAFENQVNLVPAARRKVRFRPEIYQEIAAKSSEFISAMMEDLEAYASHRSASPNYQITIKDVLLYLHRIRFIKNNSDEIDTVARLAHSVLPTETLISLDNSIAGAVEVSSGSKSSAESDDLYVDDFYGSESSDDNIAEL

SEQ ID NO: 202 - protein, 671 aa, Debaryomyces hansenii
MDDSGQRNRIRSVTEPSTPLRRSSRIDQSFAFYSHRQRTIFRTSDIHLPPHELPSIAAKLSQESNSAPGSLRRSRRRSRSRPTTPQTGRDSISGLSSGTLTPTRNNKRRSSSNFTMGNKRRKRRSLIVTENGVTALDPNYIGPITIDYLRLFCKITIEEKAEKENSKTEVHDSDPPVEPQENTPARSPGIGDRMETRNIPIFNDFDQSLPLPDVEGIPVSPESDDLGPLYDPVEIGTPPKTTFSYLERILAAQAKRNQKVDKETEHSFHKKTPDEGNMQTIDSSSMQTQFIIEDNSAHIKNVPPNDLNIRSNIEPDNNTGPKVEESLFVPEESSGIDEPTPYNEQLLDNKQLLDNEQSLDNEQPLEYEQDNNEFVGMNDEYNDIEDKMNISDLSKPDHLSEAISTPTRTLLEFTTHEELEGRSPTSPNAVVNEEYTIDNDFNNDLFEEAFDTNNEHNEIDNSLDKQTDKSTGAPATRITRSNKTKIERSHLPLPINMVKNVVKLLQAAPTRGNSTATNKQRNTQKVKRLTPDIYEFIQQKSDDFILNVVADLEAYSGHRTNNKSNQINIKDVLLYLNRIKFSSGGENRIQEVDNITNLAYKFLPLELLISLDNNLHGRVNRQKPKTYEEENHSESFETDSESDYNNEPALKRANSAQHIRHLKTFSDSETE

SEQ ID NO: 203 - protein, 469 aa, Candida tenuis
MENWESDHNHEYESVLHYEIFTDSEPNYKVTLEEQSKEETSSKSQNKETGVHPNLTTDLKIPTTVTTQESSSDNEHTTNQSFILAGNTDVLFGSPESVVASDNFIQDNPFIEPLKEANQPTRSFSYLERILASQATRNSSAVTQIVNDKLLANASLPDKFKSSNHGDTKVSFISPEKGLESTQRSPSVSTAINDEIPMEELAVLSNNEEESQSGSPSVFVPQEDDISDHSEMIQINSPTFSPTQPESFEDDIPVEGDNHSAGFPGDSSDDHDMFGYTPLDQVHKFDNDILPRIDDTSIIDKPYLVSRVSGKTNSENSNGLDSDYGLSRKTIKSLLGSLTLENNKKRKRLKSTSEALGLVQQQSETFLTNLTSDLEVYARHRGGTEITIRDVMLFIRRLKYPTVNGARANNVNYFSELAGKHLPLESLMELNNCLKNTYYTNMVEVDDQDLDDSDINEDPSIENFTDDSS

SEQ ID NO: 204 - protein, 603 aa, Candida lusitaniae
MSHSRTEPSTPLRPTTAPHDFANFSAPLRSRLSNIHLPPQELSDVISGMSSRRVSADSSRPTSGRRSAPSSSKVASRTQTPTRRLSGNLTVRRRRRSSAGIVYDAGYAGPVTREFLRAFSRALVYDKKRSSPEDDNDEMYKALDEQHRLQSVSPNDGGTMSLVRHLEPSASINSLNSAQSLPNEFDYSLPLPSAPNSPVSLTVGVTVEEPYHSIKPTFKSYLERILESRSKPAHENEQQRTAVNVLHPEEPVGHDFNAVINASQFVIENTLSSLPEYGGSRNMSISELQLQEPVAFGTLRDSSPSNDSSEKENHPVDSPSIAQHLQPSSSHETPPNTGEFGFDDLKAMEIPPWDSVLFYTSKMSTPQESVSKEIPDIPDQDLGSDSSQTGMISGHFTIGNEDVGELEHFQLKPALAEEDIGTADSDSNWMSPGEITPPGQSITDSTSKSATGSVIPKSFVKSSVTLAQRIRKSHDGHSPPKKRVKQNRLSASAVQLVTAKSNEFLQQLMVDLEAYAGHRQSNKINIQDALLYLNRIRPTANVSEIEVVSRLANRILPLEALIALDNSLQTSADRNIPKRDMSNDALDSSSTLRDSDAIMSDSD

SEQ ID NO: 205 - protein, 69 aa, Pichia stipitis
MTQEKDALSIAEAYKQITEAEKQASQLEKLLDSLEAKMDLILQEAESITKVPEEEPKEEETEEESKAEE

SEQ ID NO: 206 - protein, 86 aa, Spathaspora passalidarum
MTQESQASIADTYKQLNEAEKQAANLEKMLDNFESKLESILKEAQAISQEELKQVEEPKQEEPKQEEPKQEEQKQEEPTGDTQSSH

SEQ ID NO: 207 - protein, 190 aa, Candida albicans
MTQDIQGSMADAFKYLNDAEKQAANLEKMLDAFEAKLDSILKDAENINKPDEAEHQNGYEDDVEHTDENENENENEGDNEEEEEEEGEEEGDDDEEEENTKDKSNGKEDIDRNKDSKEDNSNANSTQAVQNKSETKLKENEHSDEKSDPTKENSKDGKVSKENTTNANDSINEKLTTDDEPIVPTTKSDE

SEQ ID NO: 208 - protein, 68 aa, Debaryomyces hansenii
MTQDNGLDLAQAYKQINEAEVQADSLEKMLDQLDAKMDSILKEAEGINKINETNETYENNEINSGASD

SEQ ID NO: 209 - protein, 63 aa, Candida tenuis
MTQEDFAEAYKQLNEAELQASKLEKMLDNLDAKMDEILKEAEDITKPSAETSEEVSQTPHKKD

SEQ ID NO: 210 - protein, 250 aa, Candida albicans
MQAFFLSFVIKNENQNQNDKVPLLTNLKTLQLPDFFTSFIYYKPDFMESLLHTCKCWGCQLVLNKLENEFYDKLIDENLETNYYMTIGYILGKLQADREVCIPIKEKTFHYNKYPINKGQPHTLHNNFHIPNENENENEEEVDNHSLMTNCCQCNIINDPLGVDELNIDNLVTTYIIHQVDPIINYLNVMFINLDNLMIHGIYYERDPLIGKMIPIYDNSEYPQSFLMEAKDYIERGLNPPGPFGTFRGH

SEQ ID NO: 211 - protein, 598 aa, Candida albicans
MKYMDSSLIFKLNNLLKFIITITKNKSIFQLIKYVVFDKSYDTFQGGSDLLIALQCQIMKIFEVSKNLNFLHISFVDFTKGIDKLTKFLSFENVRQKMFKLLITDLNQLNKPFIPPNLTNLFLLLNDHDHDDDNNNNNNNNNNKIPIMDLSMPPFDCFNSLFTLTCSTTNQLGLSILKNLKLSSRNMKLKLKGLTVFHRHKNTFLTPEQEQDEQQQQSDNSTKLDFEIINQTIDLTYLSHLYLKVDCNEHRDNLCNCYEIFFDKFSQFSNQNNGLPNLINFEIESYPNMEWLRPHQQMENILTPLSGFIKTLTNLSRLTIDFSTPGFKMFDNNLALSNYMLNKLNEHLMQAFFLSFVIKNENQNQNDKVPLLTNLKTLQLPDFFTSFIYYKPDFMESLLHTCKCWGCQLVLNKLENEFYDKLIDENLETNYYMTIGYILGKLQADREVCIPIKEKTFHYNKYPINKGQPHTLHNNFHIPNENENENEEEVDNHSLMTNCCQCNIINDPLGVDELNIDNLVTTYIIHQVDPIINYLNVMFINLDNLMIHGIYYERDPLIGKMIPIYDNSEYPQSFLMEAKDYIERGLNPPGPFGTFRGH

SEQ ID NO: 212 - protein, 581 aa, Candida lusitaniae
MMCFNPTSLQHFPPDIIARIVKRLDQSTLCNLAQTCKFLNQFATDELYRNILISVDCTYPLENGADPSKFYAHHVNINRGPTHVFSEDKLRMLISSIKHNRTIGLKIKKIKYPSDEIPLIQELISAVPKSSQPGRFSICHPEDIFERTEDTLSDIKSKSELENILCLAHPEHLNINVTEVCNLDLSSKRLEGFYELKSISCDTPNNTGLDILESIRLNSHVKLEPVKLSVKHFSYSESSSSHLRFDSIESKVDLTKLEKLDLQVDCQSDEENKCACFPKFFNDFERFSVAHDGLPRLNMLRIKLSSSEEWLHPRDFLTTVLVPIRNFIRSFVHLEHFDMNMASQTMKMYSGSGMSPNTLNKLNQRLIEAFFFPSNNKPAIHSTLKTLKLPDFLTSFIFYKPLFHESLLHTCKCLGCANFLSHVKSQVSSFFTDTLDDVTEGTLYYLVIGLILEHLQERRHIFVIDSESRLSGSCLYDGTKDALCKVLFEEHEEIPGAIKGMEKLVITYLIHQLGPFVDFFFTNFANLEELLIHGIAFKKGTYGIRSVFDDESYPPDLTTDNGGGGVSHCDSTFGSLDILQQ

SEQ ID NO: 213 - protein, 668 aa, Candida tenuis
MFDRLPTHLIEEIFQYVNQFDLLNLSLVCSQFYGPAIGRLYKRITVVLNGEFPVRYKNKSNLFIQENGIKYMDSALIFKPQNLMLLLDTLKRNKTLVSKVNFFVFDKCNSLKVDNIPVGFVQNQIMDFFGANSSDIHFLHITFIEFFHCIDKLTEFLRNNNVRNKVFKLFVTKLNELYIPCVPQNLTNLFLMLDESELADIDEIDLSSAPYNLFYSLFTLACSTNNQLGLEVLSKIKLLDPELKLNLKGLTLFHCHKESIMGDEEGNNSDPVSFNSNILSRPELMNFFDGIDKRLRFDILDSKINVASLTTLHLKIDCNEHRYNSCNCFSQFFMDFTKYSEEHDGLPNLTNFEVELFPNLEWLRPHQILENNLTPLSTFVTSLSSLSRLTIDLSTPGFKMFDNSMGMTSFILNRLNERLMEAFFLRFFTTGSTRTRLNLKTLHLPDFLTSFIYYKPDFYKSLLHTCKCWGCQLLLNKLKDLFHPLIEDDDDDDDDEEDDEARSEEMDIQSTYYILIGFILGKLQADREVCVPIKQNAFNYRNYPIYKGAPHTLHSHFHTSNSGSKCKCGISNGVADINEDPNGLEALSIDNLVTTYVVHQLKPIVEFLPSFFVQLDSLMIHGIYYEKQGSGMVPIFDEQEYPCEFLAEKDLEIRSGSHPDLPFGKFRK

SEQ ID NO: 214 - protein, 681 aa, Candida tropicalis
MSTTFDPCISTTGTTPISVDNDLKNSISIIGKTTVHPPNSIVSIFPPFIIQKILDHVDQFDLIRLSLTCSHLYGLAMEKLYRRITVVLDAEFPVKYKGDSHKYISENGMVYMDSSLILKLHNLHKFIDTVRNNETIFQLIRYFVFDKSYEAQGSETLKVTQSGILNMFRYSNNLSFLHISFVDFGEGVGQLTDFFRLRNVRKKMFKLLITEPAQLITPIIPPNLTNLFLMLDDQDIKCMDLSTTPYDTFNSLFTLTCSTSRQMGLSILENIKLCSPNMKLKLKGLTVFHRHNQCGGPDENDDLHLFLNGHTNEDGEDEDGESELNIGKKLDFDIIEQKVDLTYLTHLYLKVDCNEHRDNFCNCYETFFKKFEEFSQRNNGLPNLVNFEVESYPNMEWLRPHQQMENILTPLGSFIKTLVNLSRLTIDFTTPGFKMFDSSLGLSNYLLNKLNEHLMEAFFLSFFINNDKLPLLTKLKTLQLPDFFTSFVYYKPDFMESLLHTCKCWGCHLLLQTLKDEFFDTRIDDTVDTTYYMSIGYILGKLQADREVCIPIKEHTFHYNKYPINKGQPHTLHTNFHGDPKSCSCDLENDPLGVDEMNIDNLITTYIIHQLDPIIDYLTIMFVSLDNLMIHGIYYERDLLLNELVPIYDSYDYPDAFLTKVEDEMERGILPEGPFGNFRGR

SEQ ID NO: 215 - protein, 698 aa, Debaryomyces hansenii
MTSHLNPVVTVSPIKYPILSLEPQEQYRNSYFGGLCNKTTKQSKDSILKKLPSNLVSEVFQHVDQFDLVNLLLTCMEFYSIAVERLYKRVTIILNAEYPVRYNKNSQLFIEENGIKYMDSALIVSIEKLLTFIRVLHMNPYLIQKVKFFVFDKCYSGNLLKQGQDLSLIQSEIIEFFGKNSYEMNFLHITFVDFVTGIEKLTKFLGHENIRNKIFKLFVTSCKDLYMPIVPQGLTNLFLMLDEIELMSIDKFNLLNTPYDVFNSLFTLTCSTNNQFGLEILRKISLVNNDDEDSKLKLKGLTVFHCHNESITSDENDIFNSISNNHKHDLEYQNYVKDMEKSLQFKVISDKIDLTYLTHLYLKIDCIERRNYNCNCFSKFFKDLAAYLVSRRGLPNLISFELELFPNLEWLRPHQILENILTPLGGFVKTLSNLSRLTIDFSTPGFKMFDSSMGMSSLVLNKLNERLMEAFFLCFFTSNHLRIISNLKTLQLPDFLTSFIYYKPAFYESLLHTCQCWGCSLVLDKLSDLFFPLNEDEEIQEMNDEATFYILIGFILGKLQADREVCIPIKQTTFNYKNYPIYKGQPHTLHNHFHRGEANCRCNVKEDLNGESKLNIDNLVTTYIVHQLKPILQYLSMIFFKLDNLMIHGIYYEFNHKARRLKPIFDDEEYPPEFLQEKSKEIQSGITPDLPFGYFKKG

SEQ ID NO: 216 - protein, 588 aa, Debaryomyces hansenii
MISISDLPNDILSDIASLLHQFGLVNLSQTCRSLNFVCRQLLYTNIYITEKDYPIIECISKQSEVSTSFYNWSIINYTNRTLPRLKLFERSLKENPKLIRLVKKIITDSIKFALFKLKFWCNSLFQGSNVNEIYIGNIPLVHFQLIFDDLYSAYRSKGILSNLTILQLRHLQDLNDILKYIDIETTHVTAISFILAEIKSLGLGVDDKKKALGLFLKLTRLYICSVHHLGLNFLQGMKDDLGDDVFQVKELQISHLHGQLNGRSRFDFSHEYDPARERQLDFNVIKGLFKLENLEDIELKIGCNHIGCPPRGQNIPFDESINTGCDCLVRFFGGFYGSVSALRYLSRLSITRIGQSIVINPCNFYIFKHQLVHLFLARFETLQTLVLDTNAELHSDLYFSHIDPVPNNMVSAFINQNDKLASMILGIHHICLPDYFLSVHVWDRAQKDNSFCKCTECTTAEASITDFITTNKKIHSYVDPTSIKSSEEFYFEMVCTVLSRTSHLPHLDSIPRYLIMSHTTRPLMRLHDYFKHNLKPPTAPSCRCTGQEYLLYKSYLIHQLQAGLARRFFGSTLTLNGLDIVALAPNIT

SEQ ID NO: 217 - protein, 691 aa, Pichia guilliermondii
MSQSSVPRLMNRDHRLGSPKLPVPRNFHHKKDEVVPCVRNRTSVNGYEVQPQNSLVRRLSPQIIMDILQHVSQFELVNLALSCSSLYPLAIDRLYRRVTVVLNPQVPVKYRQSTELFIRDNGIKYMDSALILKPSSFIKFYLEMMRNPQMVQRIKFFVFDKCSSDVLAGFDLDLHTLQVQLMTHFANQSTKLNFLHITFIDFSNGMRQLTEFLHHPNIRNQIFKLFITNLTNLHTPKVPPGITNLFMMLDEYELERVKTIDLDSPEFSCINSLFTLTCRTNRHLGLEVIRLLKLPNNNDSRLKLQLKGFSLYHCHNKRVATDIIPLILPGQRTPITEIDDNDYIQAMEKTLRFDVIDSKIDLTRLSHLFLKVDCVEHRNRSCDCFPRFFNDFASYSIDHQGLPNLTSLEVELFPNYEWLRPQQLLEGIIRPVGRFIRTLSSVSRLSLDLTSPGFKIFDGALDLSSTTLNKMNEQLLESFILSIYTGQQKNNPLRVLQLPDFVTSFIYYKPEFYESLLHTCTCWGCNHVLERLRDLFFPLPNHDDFSAYYVILGYILSKLQTDREVCIPIKQRTYNYNRYPMHRGQPHALHHHFHTDTQCECNIDNDPRAEDPNNIDNLVIVYLIHQLRPIVGFLARVFRNIDKLMIQGIHYERNCCRFVPVFDDERYPPQFLQEANHVGNTVPDLPFGKFR

SEQ ID NO: 218 - protein, 672 aa, Pichia stipitis
QPVDSVVSILPPSIITEVFQHVDQYDLLNLLTTCTALYSLATDRLYKRVTVLLNAEFPLRFSTARDYVLENGIRYMDSSIILTLDSLVKFLSTMNSRPDLIQKIKFFVFDKCQNLEKIDVNAVQLNIIEFFGANARELNFLHITFVDFLTGIVKLTNFLRNANIRNKIFKLFVTKTSELYEPCIPPSLTNLFLMLNEVELIDQEYLFDLSKHPYDVFNSLFTLTCSTNHQVGLEILRKFKLFAPGMKLKLKALSLFHCHKEAVEGRSEFTDEYASQFSLLNQDNDKVLLEKYMQQISKKLDFSVIDEKVEVANLTHLYLKVECIEQRHSQCNCFETFFKDLTKYSESHGGLPNLVNLEVESFPNLDWLRPHQILEDILTPLGGFVKTLNNLTRLAIDFSTPGFKMFDNNMGMSTWLLNKLNESLMESFFLCFFTASNKLNLVANLKTLQLPDFLTSFIYYKPDFLESLLHTCQCWGCALVLEKLAESFYPIFNDQDDDDLDEERDETATLDLESTYYVLIGYILGKLQADREVCIPIKEKTFSYRNYPIFKGQPHTLHNGFHKATGDQNGADACSCAVDEDPQGRSSMNIDNLVCTYIVHQLEPIIQYLSNIFTNLDNLMIHGIYYEIDKYNDKLVPIFDSSEYPAQFLENKKDEMDRGVKPSGPFGYFRNC

SEQ ID NO: 219 - protein, 651 aa, Spathaspora passalidarum
MITQQNYVIPDTPASSSNYHCEHEILPYVDQFDLVNLSLTCSALYLPAIKKLYRRVTVVLDAELPLVYDIDHRRYISENGMTYMDSALIFTFGNLLKFIESIQSNVELVQLVKYFVFDKCHQDEQETSLTALQSNILEFFAAKSQHLNFFHISFVEYLSGIKQLTDFLKHENIRQNMFKLVVTSLDELYTPNIPRCLTNLFLMMNELELKEPFDLSEYPYDVFNSLFTLTCSTSRHLGLEVLQNLKLCSPSMKLKLKGLTVFHRHKEITNAVEEEGEDEEISEDLDAKLQEIDKKLSFTAIESKIDLKYLSHLYLKVDCNEHRHNMCNCYESFFNDFAKFSLANDGLPNLINFEAESFPNLDWLRPHQQLENILTPLGGFIKTLGNLSRLTIDFSTPGFKMFDNNLGLSTMLLNKLNEHLMEAFFLCFFTVDNTSNCKSPLLNNLRTLQLPDFFTSFIYYKPDFMESLLHTCKCWGCQLVLEKLKDEFFDEQDENGLDIESTYYMLVGYILGKLQADREVCIPIKEKTFNYSKYPIYKGQPHTLHQGFHSVASPCNCNLEQDPLGVSKMNIDNLVTTYIVHQLAPIIEYLSVLFVRLDNLMIHGIYYERKNGELVPNFDEMDYPEEFIQVKQDEINGGIRPEGPFGNFRGV

SEQ ID NO: 220 - protein, 477 aa, Candida lusitaniae
MGFLKVNGTKIVGSDGKPVVLKGTATGGHLNMENFITGYPGHETEHKQVMESKMGTEKFNYYFDKFYEYFWTEKDAIFFKEELNLNCLRIPFNYRHFIDDNDDLFKVKPQGFLLLDRVVESCAKHGIYTILDMHAVPGGQNQDWHSDSGIHKSLFWDFKVFQDAIIHLWKKIAEHYKDNVWVAGYNPLNEPAVADHSKLVNFYNSLEKEIRNVDPNHILFLDANTYAMDFRQFPKTPWPNCVYSIHDYSTYGFPGYEKDTYAGTDEQKAKLESQYNRKLEYMRAAGVPVWNGEFGPVYASEVRGDSEPEKTNRARYQVLKDQLSIYKKGDPSGDGSPISWSIWVYKDIGFQGLVYVDPKSKFFEVFEKWFLKKKKLGLDRWGNDIDKENAKLYDALVGHMKENIPEKYQKALYPHNWSIKDYVARVARDMLFSQYAQHEYADLYAQLSFEDLDELASCFKIENCVKREELNSILREY

SEQ ID NO: 221 - protein, 477 aa, Candida tenuis
MAGFLKVKGTKIVDENDHPVVLKGSATGGHMNMENFITGYPGHETEHKQVIKSKIGQEKFDFFFDKFYDYFWTESDAILFKNLGFNCLRIPFNYRHFLDDEGDLFEVKQKGFERMDKIVDTCAKHGIYTILDLHATPGGQNQDWHADSKIHFAMFWEFKVFQDAMVNLWGKIAEYYKDNKWVAGYNPLNEPAVSDHSKLIKFYERVDKAIRAVDPNHLLFLDGNTYAMDFRQFPDEPLKNAVYAIHDYTTFGFPNLEGTEYQGTSEQKTKIKSQYERKIEFMKSRNVPVWNGEFGPVYASEVRGDKDPHTINKARYNVLKDQLAVYKTGDPSGDGSPISWSIWVYKDIGYQGLTYVSPKSKWYQLFGEFFLKKKKLGLDRWGNNIDPEFAKLYADLEAHMKKNIPEKHHKAIYPHQWTINDYLYRVSKDMLFSQYAQHEFAELFVGLDFDELDELAASFKLENCLQRDELNQILREY

SEQ ID NO: 222 - protein, 460 aa, Candida tenuis
MTGFLKVSGTKIVDQTGTPVVLTGAATGGHLNMENFITGYPGHETEHKKVILSKIGQEKFDYFFDKFYEYFWTKEDANVNAKGFERLDRLVDTCAANGIYTILDLHTVPGGQCQQWFSDSPTHFSWFWDFKVFQDAIVHLWSQIAHYYKDNQWVAGYNPLNEPASSDHSKLVRFYERIEKAIRGVDPHHVLFLDGNTYAMDFSQFPDQPFSNSVYAIHDYTLYGFPRGLIGTGFVEPYQGTEAQKAQLQKQYQRKVQYMKQHGIPVWNGEFGPVYASSFRGDVDPEATNRVRYQVLKDQLEVYKHGDPSGDGSAISWSIWLYKDIGLQGLTYVSEDSKWFEVFGKWLQKKKKLGLDAWGNDIDPEYQKLYTRLGEHIKANVPEKYHRVMYPPIMDIDGYVNRVTREMLFSQYCQHEYADLFVGMDFDELDELAASFKLENCARRWELEEVLRGYSEESTK

SEQ ID NO: 223 - protein, 480 aa, Candida tropicalis
MSSGFLTTKGTKIVDAEGNPIVLKGTACGGSLNMENFITGYPGHFTEHKNVIAKKIGTEKCEFFFDKFYEYFWTEKDADFYANELGFNALRIPFNYRHFIDDQGDFFKINPKGFERLDRVVDICAKYGIYTILDLHAVPGGQNQDWHADSGIHKSIFWDFKIFQDCMINLWVEIAKHYKDNTWVAGYNPLNEPASPDHSKLVEFYKRVDKEVRKVDPNHIWFLDGNTYSMDFRQFPPADFIPNSVYAIHDYSVFGFPSLDGYLYQGTDAEKAKLKQQYERKLEYMKKYNVPVWNGEFGPVYASKERGDEDPDSINRHRYNVLKDQLEIYKKGDPSGDGSPISWSIWLYKDIGYQGLTYVSPESKWYQVFGKWLLKKKKLGLDRWGNDIDPKYAKIYHNLIDHIKENTPEKYHKALYPHNWTVEDYVYRVAKDMLFSQIAQHEYADLFVGLSFEELDELAASFKFENICKRDELNAILKDY

SEQ ID NO: 224 - protein, 476 aa, Debaryomyces hansenii
MGFLKVKGTKIVDENEKLVVLKGAATGGHLNMENFITGYPGHETEHKKVIENTIGKEKSDFFFNKFYEYFWTEDDAKFFKQLGLNCLRIPFNYRHFINDEGDLFDVKDIGFKRLDAIIDTCSKHGIYTILDLHSAPGGQNQDWHSDSGIHKSLFWEFKVFQDAIVNLWIKIATYYQHHEYVAGYNFLNEPAVSDHSKLIKYYERLEKEVRKVDPNHILFLDGNTYAMDFRQFPNEVLPNTVYAIHDYSLYGFPSNDNDLYKGNKEQKDKLKSQYERKIEYMRDRNVPVWNGEFGPVYASDFRGDKDPDLTNLARYQVLKDQLEVYKSGDPSGDKSPISWSIWLYKDIGFQGMTYVSPESKWYSLFGKWLAKKKDLGLDRWGNDIDPNNAKLYTDLENHILSNVPEKHRKALYPHNWTVKDYLARVTNEMLFSQYAQHEYADYFKDLSFEQLDELAACFKFENVEKRQELNNILSNY

SEQ ID NO: 225 - protein, 477 aa, Pichia guilliermondii
MPGFLKTKGTKIVDGDGFVTVLTGAATGGHLNMENFITGYPGHETEHKKVMKSKMGAEKFEYFFDKFYEYFWTEEDAKFFKSLGFNCLRIPFNHRHFLDDEGDLFQINRKGFARLDALVNTCAKHGIYTILDLHTAPGGQNQDWHCDSGIHKSLFWEFKVFQDAIVNLWVEIAKYYKDNIWVAGYNPLNEPAVADHSKLVDFYNRIDKDVRAVDPNHILFLDGNTYAMDFRQFPSKTIPNCVYAIHDYAQYGFPNLEGTLYKGSEEERAKLKSQYERKIEYMKAHNVPVWNGEWGPVYASKVRGDSDPETINRARYNVAKDQLAVYKKGDPSGDKTPISWSIWLYKDIGYQGLTYVSPDSKWYKVLGDFLIKKKHLGLDRWGNDIDPKYAELYANLVDHFKANMPEKHQKALYPHNWSVTDYVYRVTKDMLFSQYAQHEFAELFAGLSFEDLDEMAASFKFENVLKRDELNEILRAY

SEQ ID NO: 226 - protein, 483 aa, Pichia stipitis
MSTGFLTTKGTKIVDANGKQVVLVGTAIAGHLNMENFITGYPGHETEHKNVLKKKIGEEKFNFFFDKFYEYFWTEKDADFYKNELGFNCLRIPFNYRHFIDEEVDLFKIDPKGFERLDRVIDICSKYGIYTVLDLHATPGGQNQDWHVDSGIHKSSFFDFKVFQDSMVNLWIELAKHYKDNTWVAGFNPLNEPAVSQHKKLVNFYQRLHDEIRPIDPNHIFFLDANTYSMDFRQFPAPKDFIPNAVYSIHDYSTFGFPNIQGTLYTASDAEKEKLKRQYDRKVEYHHEHNVPVWNGEFGPVYASKERGDEDPDTINRARYQVLKDQLAIYKKGDPSGDGTPISWSIWLYKDIGYQGLTYVDPESKWYKVFGEFLLKKKKLGLDRWGNDIDPEYNQLYENLANHILENVPEKYHHALYPHHWTVLDWLFRVSKDQLFSQYAQYEYADLFVGLSFEELDELAASFKFENIKLRDELNDILKDYKN

SEQ ID NO: 227 - protein, 481 aa, Pichia stipitis
MSAGFLTTAGTKIVDAEGTPVVLKGAALGGHLNMENFITGYPGHETEHKLVLEKKIGKEKFDYFFEKFYEYFWTEKDAEFYRNKLGFNCLRIPFNYRHFIDDNGDLFKIKGKGFELLDRIVDICSQYGIYTILDLHTTPGGQNQGWHSDSAIHKSLFWDFKVFQDSIVNLWVELAKHYKDNVWVAGYNPLNEPAVSDSEKLVDFYKRLHDEVRPIDPNHIFFLDGNTYAMDFRKFPSPESYIPNTVYSIHDYSTYGFPNLEGALYTGSEEEKSKLKSQYNRKIEYQSEYKVPVWNGEFGPVYASKERGDKNPEVINRARFNVLKDQLEVYRKGDPSGDGSPISWSIWLYKDIGFQGLTYVSPKSKWYEVFGEWLLKKKKLGLDKWGNDIDPGYNQLYQNLVDHMEANVPEKYHKVLYPHTWTMEKYLARVSRDMLFSQYAQHEYADLFVGFSLEELDELAASFKFENLDQREELNQILKEY

SEQ ID NO: 228 - protein, 481 aa, Pichia stipitis
MSTGFLTTKNTKIVDANGTPVVLVGTAIGGHLNMENFITGYPGHETEHKKVLKKKIGEEKFNFFFDKFYEYFWTEKDAEFYKNELGFNCLRIPFNYRHFIDDEVDLFKINPKGFERLDRVIDICSKYGIYTILDLHATPGGQNQDWHADSGIHKSIFWDFKVFQDSMVNLWVELAKHYKDNTWVAGYNPLNEPASPDHLKLVNFYQRLQDEVRPIDPHHIFFLDGNTYSMDFRQFPAPKDFIPNSVYSIHDYSTFGFPNIQGTLYAGTAAEKDKLKRQYDRKVEYHLEHNVPVWNGEFGPVYASKERGDEDPDTINRARYQVLKDQLAIYKKGDPSGDGTPISWSIWLYKDIGYQGLTYVDPESKWYKVFGEFLLKKKKLGLDRWGNDIDPAYNKLYQDLIDHIHSNVPEKYHKALYPHGWTTQDYLFRVAKDMLFSQYAQHEYADLFVGLSFEELDELAASFKFENIKQRKELNEILKDY

SEQ ID NO: 229 - protein, 480 aa, Spathaspora passalidarum
MSNGFLRTQGTKIVDGEGKPVVLKGTAIGGHLNMENFITGYPGHETEHKKVLKKKIGQEKFDFFFDKFYDYFWTEKDADFFANELGFNALRIPFNYRHFIDDEGDFFKINPKGFERLDKVINSCAKYGIYTILDLHAVPGGQNQDWHADSAIHKSIFWDFKIFQDCIVNLWIEIAKYYKDNTWVAGYNPLNEPASPDHSKLVNIYKRFDTEIRKVDPNHIFFLDGNTYSMDFRQFPPADFIKNAVYAIHDYSVFGFPSLDGYLYKGTDEEKAKLKQQYERKLEYMQKYQVPVWNGEFGPVYASKERGDENPEFINEHRYNVLKDQIAIYKTGDPSGDGTPISWSIWVYKDIGYQGLTYVDPESKWYQVFGKWLLKKRKLGLDRWGCDIDPENDKLYENLVQHILDNTPEKYHRALYPHNWHVKDYVYRVCKDMLFSQIATHEYADLFVGLSFEELDELAASFKFENTVKREKLNAILKDY

SEQ ID NO: 230 - protein, 616 aa, Candida albicans
MNKSLVPSSSSLLNVNRILVRNVATKQLAPSLSVLSTRILKNHFTTKFKQHSIAFNKQRYFSTFSRSYQEPLNKHTQPKDELKQTITKATLLSQANSGLSRMLIHLKWPLSRNTNTTSTWDMTSAFISWLVMGNILWIILGTTTFGLTLMYSLHYLDSLVGKFSDDKETTDKLNQTKSKTSTNVMSYLIGGIISFGIGVDLNFEKGSSLPELKDGKLRFKNVGIVSHDGNNKHVKFKGTVEAMDITLSFNKWYEGNGLIYDLELYGLNGKLYKSRSPSPPVANTTKKSYRFNENIHYQYDLDHNVEEIASGSSSIIDNNYTFDHVKIHDSYLEIYEEQSSTPIKINIFSCDLPKLRGDKLVLDFFNANNASGAINDAMFTLHKRQNLDPENKNQDKLIRFKLDAIDLGEINKYDPNSKFNWIINGKAEVIADITLPEEQDDLNESITEVLTKMFTNMFQTADMSQTSEDSLLKDAISAIYHTFRKPEETAKPAENSYVMVNVKMKLYDLKASLPQVLPRTNNGIPFISLTDLRSLISFINTENQPITIKSTVIEKITDLSNIQHLGQTKMFDYIMGDAYEELTNLVRDDARRIINEKSWSNSIATQLLLLGLGAMV

SEQ ID NO: 231 - protein, 613 aa, Candida lusitaniae
MSLIRRQMINRNSCFRILKARQQPWSSLIRNTFPVQSSRLLHSSRTLLSKKENITKSQLLEQASSSLSRLWIHIKWPLTRNNRPFSLDDFSAFASWLLMGNVLWIILGTTTFGLVTMYSIDTFDRFWNVVKGEQNSGSEDKDTKKKSNDDSFLGFIASSILSQGLGLKFVFQKGNVVPEFADGMLKFKNLKVYSTKSPAEELSFIASIQELNLSLSFKKWYKGNGLIYDMEIFGMDATVYKNLESVANEAPIKDKSIPLSSMALSFSKYNDRTYNDIDEHGTEQLERLEQSPKLSSLAPNYEFSHVKIHDSVIALYEGTDRVPLKISIFSGDLPRLRGSRLLLDFFNANNVAGAVNDAMFTIHKHQTFLNNENVVRFKLDGIDMGSLSKANPQSKFNWIANGKAEIIANIRLPPADGAKEDGHSNAPLLSGIFQKLLDEFKVLTSPKEQELSNEHPESSLVKSAVTAIYETFSHNKEEKPIMNEAEYVIVDVKVKFTDLKATLPQELPSASSSSVPFVSLQELRSLISYVNEVETDSDHPIIINTTVIEKMSDLYNLDNISQTRLFDVIVSDIYDDFSKLIKLEEKRIIEEKSNMWSHSLASQLLLLGLGVLA

SEQ ID NO: 232 - protein, 614 aa, Candida tenuis
MYSIRTSPGLLSTSFKSHRHIFGSGGIFIHRSIQPAILRSQKRSTQSDEKFQLTKSKLLAQASGPLSRLLIHIKWPLKRNNKPFSIDDMSAMFSWVVMGNVLWILLGTTTFGLTLLYSLHTFDSLVNKILAYFNHDNDDNNDNNDQNKKDDSILGYLTSSILSHGLGIKIEFEKKGILPEFNDGKLIFKNIRLKSLDNEHSNVSFSCDVQSLSLSLSFGKWSDGHGLIKDLEIFGLNGKVLKKYELHSSSVDTASPFVFRRLHDSIHFQFDMSDQKDVLASPKKPRVDPNYELNSVKIHDSYFEVFDSKTQDEPLKFSIFNCELPKLTGKSLLVDFFNASNVTGSINGSMFTIHKKQDYNARPSENTIRFKLDGIDMGGLAHSNPQSKFNWILNGKAEIVADIRFPSPGVEENSLFKIEYKRFAEIINRVFYDLGTINNKNDEPITKRDDSHDDAKLMKGALQAIYQTFNMDQEDNRQIVSSEFNSEYVFIDAKVKFYNLQATLPKELPLASTGNVPFLNLHDLRSLVSYINKIDTENKPPITMKTMVIEKLEDLYNVEHLTQTRVFDVIVSEIYEEFLKMVKMDEERIISEKSSLWSHSVASQLLLLGLGAIV

SEQ ID NO: 233 - protein, 635 aa, Candida tropicalis
MISRSLTSPSITRTLTHNALKSTSHIVPISILSTRTLISRRLLFNQINSQPSQSFIHLLPRYFSTSTRFTQKHDPLENKKRTELVPFVTKATLLSQANSKLSRMLVHIKWPLLRNTNSTSKWDVMSAFISWLVMGNILWVILGTTTFGLVLMYSLHYLNNLVGTFTDRASSREGDDESDKKPNNVLGYLIGSIISFGLGVNLKFEKGSTLPEFKDGKLRFKNFTIVSNENTDKSIQFKGKVEAMDITLSFNKWYEGNGLIYDLELFGLNGKLYKSVRSTPDETTSSKKSYRLNENIHYQFDLDNDVEEITTAKKKNTNTPIIDENYIFDHVKIYDSYLEIYEDQQAETPLKINIFSCDLPKLRGNKIVLDFFNANNASGAINDSMFTIHKRQNLDPESSQDKLIRFKLDAIDLGEINKFNPDSKFNWIVNGKAEIIADITLPEMQQQQDDLNKSIGEFIGKIYENIFYQNANNGNNTNAGNPSEDSLLKDAIAAIYHTFKKPEEESSPKHAENSYVMVNVKMKLYDLKASLPQVLPTANDGTPFISLTDLRSLISFINTENQKPITIKSTVIEKITDLSNIEHLGQTKMFDYIMGDVYEEMSYLVRDDARRIINEKSWSNSVATQLLILGLGAIV

SEQ ID NO: 234 - protein, 653 aa, Debaryomyces hansenii
MPLNGGISNFARPMGYFHRPLSGSSIFSRIMTSQRVKSEWRSVCGVKHQAFFSTIGSIQNQHKDKSEKNNSKITKAALLSQASNRFSKFLIHIKWPLMRNNRPFTMDDFTAFFSWLVMGNVLWIILGTTTFGLVTMYSIHTFDNIRNSIKAYYTGDDEDNSGNGDRKHSDDSILGYITSSILSNGLGVIIEFKKGNVLPELKDGMLRFKKFNVYSIHTSSEAGEDEGKLEEKTALKFKANVETMDISLSFGKWYEGKGLINELEIYGINGKVYKSSEDHQDASVEEYLPFSAGRYNENLHFQYDMNDHNAEELELVKQKRKNILMESNYEISHVKIHDSYVEIIDVSNKNPLKISIFNCDLPQLRGNRLLIDFFNANNVTGAINDSMFTIHKRQEFNNPTNDNKIVRFKLDGINMETISHSQKLKFNWIVNGKAEIIADIRLPSVNQESENSFTLGNEYKKISDICSEIFDELIDVTSPSSPEKLPSTEKNDNDNTLLKSALAAIYQTFSPSSSESKKSYNTTDSSSEYVIVNFKVKFYNLKASLPQHLPMALSSSLPFISLQDLRSLIAYVNDNASNKPIIIKTTVIEKLSDLYNIENLSQTKIVDEIVSDVYDNLLKIVKLDEKRIINEKSSSWSHTVASQLLLLGLGVLA

SEQ ID NO: 235 - protein, 593 aa, Pichia guilliermondii
MLKSLGIRPMKSLLESRMAPEIQALTYRRLPLLAFRTSKRNYSKVPPSSKISHSKELIIPTKHELLKHASGPIQRALIHLKWPLTRNNRPSASDVVSAALSWFVMGNILWIILGTTTFCLMGLYALDTLSNVWKSVSPGETKESSLVGKLTSAIVSQGLGIKLEFTPGQVIPELKDGMLRFKNVRVVSTLPETKFDGTIDALNVSLSFQKWYEGKGIIDELDIYGMHLKLYYENDSEPHMTVGNDSVPSYRFNDTMHYQYDLPNSPENEEASVSPATLIDTSYELSSVKLHDSYFDIHESEAVEPFRVAVFNCDLPQLKGDRILLDFFNANIVTGSMNDSLFTIHKRQTETASADSAQRTVRFKLDGIDLGAISQKNPRTKFNWIVNGKAEIIADIRMSSLSEKEDKKFSNVFSSSFRELLSLTDPKSTPSDEQESNESNLLKGALAAIYTTFSSKESQPSTIQNNDYAVVNVKVKLKDLKATLPKYMPMATSTNTPFISLHDLRSLVAFANELGGSSPPIVVQSTAIERLSDLHNTENIFDTRIFDSIVNDVYEELLKMVHLDEKRIIEEKSSSWSHSVASQLLVLGLSAMV

SEQ ID NO: 236 - protein, 161 aa, Pichia guilliermondii
MFRLALRSGNVLRRDAGINIFRSVYNPRWSKPISTKLQPLTRINAFPHKMAPLRLYSTNSEKEQQSKLPPKPTQPQRSPRVTKEQLLASANNFISRLGIRIKWLMKKSNRPFNTDDYSAMFSWLVMGNALLFILGTTTFFSLVILTFQYCICPGICGSKIG

SEQ ID NO: 237 - protein, 737 aa, Pichia stipitis
MTSLVRTIGISHPELPVAALKMVATYLRTSSRLPLASNSLHLSRHFHKSISSPQIGIKAVGLFQARQFSTRSVMYQSISNTTQYSQRSIGTKIVTRKAELDCFTDPKFISRASNINIGKSTSTLLAVKAVETQSNTAIQAGSKAASIVKTSGITKAALLSQASNSFSRLLIHVKWPLIRNSSNTTTLDLVSAFISWMVMGNLLWIILGTTTFGLMAMYSIHYFDHLWDSISLFQDNEQDGDDMDDQKKDSSILGYITSSILAYGLGVRIQFQKGSILPELKDGKLRFKNFKIFSAENNNRSESEDDTVGSITKFTANVEAIEVTLSFNKWYEGNGLIYDLEIFGMNGKVYKNQVVENKSHLDEALTYSLNRHNDNIHFQYDLQDHDIEELDSVRNAQISKNTFMDSMYQLEHVKIHDSYFEVYNNDSTETPLRISLFSCDLPRLRGDKLLIDFFNANNASGALNDSMFTIHKRKEIDHYSLTKDEGNKIVRFKLDGIDMGSISRANPHLKLNWIVNGKAEIMADIKLPDLSDSEFQLSQEYKRVSNVVSDMFNELVNVTKPTDDKEVDIEGNSATLLKGAIAAIYHTFTKPQHDDNEEVRSEYVLVNVKVKFYDLKASLPKHLPMASSSATPFVSLQDLRQLIGFVNNTNEENASSSTFSRNNPLIIKTTVIEKLSHLYNTEDLSKTAIFDSIVGDIYEDLMKLAKQDEKRIIHEKSSMWSHSLASQLLLLGLGAMV

SEQ ID NO: 238 - protein, 557 aa, Spathaspora passalidarum
MNQLIRSSTASRLLGKQLAPASILSRYSLARIIIPLPPITKATLLSQTNSKLARLLIHLKWPLLRNTKTSTLDVVSAFISWLVMGNLLWIILGTTTFALMSMYSIHYFDELYEKFNDGEEKEKGGKDNSILGYIAGSILSFGLGIKIQFEKGSILPELKDGKLRFNNVSVTSDKSSKLAIDAKVEALDVTLSFNKWYEGNGLIYDMEIFGLNGKVYRKSEEEQANPPPPHESLNLSYKNHDLHYQYDLMEEEEVRTPSLLDSNYQLEHVLIHDSYLEIYDESEVPLCINIFNCELPQLRGDKVLIDFFNANNASGTINNSMFTIHKRQRDEVTEDRIVRFKLDAIDLGEISKNNPQSKFNWLVNGKAQVIADIKLPNLQETEEYTKLASIISRFINDFSITSTVEPDDSSLLKDAISAIYHTFNKPEQTQLSTSPYVLINVKVKLTDLKASVPKYLPTSNSNTPFISLTDLRSLINYINTNPQPISVNTQVIEKITGLYNTNNISSTKIFDFIIGDIYEELNKLVKLDEQRIISEKSSMWSHSIASQLLLLGLGVIV

SEQ ID NO: 239 - protein, 630 aa, Pichia stipitis
MSPGIGDDDEEYLKRFVTEFLPELPDHVVWSIVNMLPPEYIFDFLLYLPDSAIRDVLKDQLYNKQLHLLLLPRTSSYRKELVTVSPYVKLMGYFEITQFLRDNEDLNPAKLVLDGCGDVPSLKSIMETNRERLTTKVGDLVVLADNDVTTADVNFFLSFPNLKRLQIHQLQTKERNLVRINENLKKHKNLDTIIFLGHNYRDWTGVEFPRSLSHLDLSWYDFTKPETIQLPPGLKELYLNKAGVNLLNISKISFPENLHTLMLTYNDIESVDLSDFPRNLNTLDLSYNRILDVYDRKGTGWPSQLKSLLLTQCGIDDAIFQQMASLKWPQDLKNMVLTNNPITSFSNLDFPPNLELLDLSLTRLGSLYDTRNSPHKGPYFIFPESLKILRMFELSLRVNEEYRGLRMKLPSSLEQLDLTECFLSHLEIFEFPRSLQVLRMSGNKISDLKSYNNEDVNWSQLVNLKRLEMDFNRIGDLSDWYPPPNLEVLNLTQNPLRMIHSKFPLFSTPPVLLKELNLSFCSIEDIDEKITLPPFLKIFDLHDNFLQDTFTIPSAICEHKHLKRLDLSRNGITKLSYGSKGSSKLKTLDLSENMIRSSRTELEDFYSAMATGLGVVVRNKRFKINSIHNF

SEQ ID NO: 240 - protein, 492 aa, Spathaspora passalidarum
MIISYGDWSSSFLEHYFPRLPEDIQNCIYELSTGNDLLNLYTRFRNAAVHSSLSSYYSQEILFIPWGSSSSFSRRMDNNKRMLPIIRNNDDVIQFINEFPKVIPNRLHIHCNNYGFSSMQDILDMYGDRIYQIKELEITLAGYILLTPNKFNYLLSFPNLTTLQLYSTRWEKRLVKNSIPINHPTLRKLEFSQFVYGVGNDNVDYYIDWSGFEFPQNLQELSLTGIANISTITIPETTTHLHFNCAKIGDIVSCKSMLENVTELSLRWCRLQVIDLDVLPAGLRILDLSYNRIGRIVGNYKSALPEDLHTLKLNMCTLDDVVLDHINENIGWPSQLTRLEISSNNFSKIDILEKLPETLKTLWLSRNHLKWDEGEVLFTFPHLTELCLHRCGICDLQNFQFPSSLKNLTLCFNEIENISSYQGWNNLVNLHTLSLCRFSRQNLNGWIVLPNLRELHLAYTENDQLNNKFGVSSENYNLQIITSGCRYCNRNT

SEQ ID NO: 241 - protein, 598 aa, Spathaspora passalidarum
MTTNDDEYLNTFLESYLPRLPDDIITQIFDFLTVDHLIDFFMYFPDVSIRTLLIRHYYSNELHFVIMPTKRPYVSTYPIHKREFITFHGMEIFRFMDDFPEIVPKRLLLVSGASSFQGIKEVLEMYRDRINRVDEIEVTLERCELTLADFQFLISFANLRKVHFSGMSLKMVRRGLIHNTALMEHPKLNEIVFLGHEINDWSGIQLPSVLNSLDLSWNNSTDISTLIIPTNVNDVYFNKSNIHNLEILSNKIPSNLTTLMLTYNEIETIVIDHLPPRLRTLDLSSNRIKSITGNTWPVDLDILLLNDNKLDDRALKLINDFIGWPARLTNLGISNNELTKIENLSNLPRWLEILNISMNPLVCDDNQQTPFEFPHGLTNLNMTECKTSDLHFLQFPTSLKNLTLAGNRIVDISSYGHWQKLVNLDTLELFHNLIDHLDGWIIPPNLTKLDLQVNPITELNSKFPLFNDNYQFKLSDLNLARCRITKIEVDHIPASLKRLNLSMNRLNSKFEFPPSFKQLSHLDLSENEITSIVFKNGEQSQLQSLDLGKNSILRGVASSGLGIVGINQFYDDLELHLGKVKKRKFNINSLHVFERGRL

SEQ ID NO: 242 - protein, 548 aa, Spathaspora passalidarum
MQIFDLFNRSDLWTFLTNFPHHDLRDLVLHHYYSEVAFIVHSEVSWYHRYFLDITQFFNEEIFEFMDTFPENIPRRLIITFDNESFSTIEQFLERYDERIRKVAQLEIALERCQLGDCDLNYLLSFKNLTKIYVQNMNLSNTKIFDNTYWTDHPRLEEIILVQDCVDDWSSFRFPEKLKCLELVQTELDHKLIIPKSVKTLSISGSKLDSLEIFQNQHSCDSTQNLMEDQLPAGLRKLKLETTGIYDFNRIHWPTSLEVLSLAETGLNDSALKIINNLHRWPPGLIDLNISNNPIRLPNFASRLPSNLKILEMNQVELSWLESEHPIEFPETLTELYMNACKIPGLDVLSFPTSLKKLALTTNQIEDVASYDWEILVNLETLDLSGNNITSLDDWMIPPNLINLCLFANPINELSENFPLFIDQYKFNLEYLDLRFCNIKSISVKYIPASLKMLILLGNSLGSNLVLPSSFKSLQHLNLCRCGLATVEFRDEDKQLTTPSPRRKPLDLPAFYSYDWKLCLGKIRKSTNTFHEECLETFRGREPIWLID

SEQ ID NO: 243 - protein, 477 aa, Spathaspora passalidarum
MSIANSEFTMLLRTNLRRLPDCVITQIFDSVPFDHLMEFCKHYPDKYVRDLLIQYYYCSRVQFAFNPPVPPPKATPGRRNLVTFVDSAVSQFMEDFPEVIPKTLLIDVCMDFKEAREILDKFHDRLVKCEVIDFALLEAEISADDFQFLLSFPNIKRVYFHFNSKLLLPALIDNPKLIKHPTLEHIIFCEHEITDWSGVRFPQNLKTLNLSYHRINFSTLILPQSVHSLSFIYCQIYSIKALRRQMTNELTELKITDNMLEHIVIDDLPRKLHTMDLRRNSIFSITGKEWPKGLKSLILSHNALDDDSLKVINNGVGWPEQLITLDLSVNFFDHTENLSNLPQSLKRLEISSNTFLWRDQENRVEFPVNLTYLGMSDCRVHNLSLLKFPVSLKELQLAHNGIKDLLPYGDWTELINLRQLDLFDNSITTLDNWIPPPNLRELIVENNPITRSPQFNELRNTFKFKITGMKSESNQQV

SEQ ID NO: 244 - protein, 523 aa, Spathaspora passalidarum
MPADNNDWVMKFLTFYLSRLPDHAQIFIFDLLDPEYIKDFFLYFPDNKLHQLLVDHYFSKVLHFQMGEIVAHHHEFMYDYTSSEVVSFYGMKNILRFMKDFPKIVPRRLLLIGESDGGILKDDRISKIDELEVIIDGSDIDPDYFDYIISFPNLTRLHIMDEFIGEGMLDSRKFTKHPKLQDVAIISFEADFSDIKLPKSLRKLGVTSCSFDISDVKIPKSVSHICMSKCSIDDFAELATILPKSLSSLCLCDNELEGIVLDDLPAGLRSLDLASNEVSIELDNSNKTWPIDLCELNVSGSTIDDLFLEQLDSSIGWPKKLTKLDVSCSQINQIGKLQLPESLEILNISSNPLSWDCIKETPFRFPGNLTVLDMTECGISNLNCLKLPQSLKKLRLGNNGIDDILSYDDWSELIHLHTLDLSQNKIISLNNWKSPPKLIKLVLSNNEISELSSYCDWKALVNLRTLDLASNKITSLDNWLKPPNLVRLDLSRNPSDELSLKFPMFKEKIDAPYRSFTLASIKD

SEQ ID NO: 245 - protein, 374 aa, Spathaspora passalidarum
MDNFPDVTPNTVDLIHSGSDFKDVMEILRCKITIEDFKYLLSLDNLKRLLLSRMDLRMIQSELNNNPRFSNHPNLASIEISYLNAKVPENLCRLYLVNAGLESIVVDELPVGLKYLSLAKNEIYTISGKSWPGSLEYLSLADNEFDDDAVKELVETIGWPPILKFLDISGNPIQHLQTLKRLPGDLQTLVAAEVPWKLSKRQVGEFPSNLTGLALHCCYFGNLSHFLFPPSLTSLRLIHNEIKDVLSYSDWSQLKNLYKLDLSSNSIKSLDGWILPPNLLQLRVNCNPIKKLTSKFPLFNRNYNFRLLRFEMRECKIKKVDIDYVPPNLKVFDLSTSKLPKSIVWPTTSNHFQQLLLPKNVECIFRSEKISVIE

SEQ ID NO: 246 - protein, 533 aa, Spathaspora passalidarum
MNHNDTWLINFLSTFFQSFPNDIINVILDLLTQKQKHVFVTDFPNNNIRSVARANYYRNIHFVTPFSRSYVLFHFEKSTRVTFVGMDKILHFMDSYPDVIPKTLVLEISFLDYENLKAILTKYHDKISKISEMSIILKNYEINIAFLNFLLSFDNLTNLVFEQTSLKSIRRFFINNSRFIHHPRLSSIRISSSYVIDWSGVQFPQKLKNLELPRAKISTVNIPAEVGRICFTKSKIKHSNELRNKLPENLTVLELHSTGLECLMVDDLPVGLTNLKISRNPLNKIYGKRWPPNLQKLELEFHKLNDEALQFVNESIGWPLNVTHLTISGTKLKDLSNLSNLPQSLKHLNISNTHWNLVKENTRFEFPRNLKILHMSFCGLPRLKYLKFPSSLEDLSLPLNRIHNILTYGAWQELVNLKRLDLDYNSITSLDNWVIPPNLEYLCLSNNRIKEVTSRFPLFNNKYNFNLKVLKLSRCQLSKVRIDYIPPSMVRLDLYQDDLIAQIVLPIDSKPCLIPRGYRFKRMNYMPVNYCKV

SEQ ID NO: 247 - protein, 413 aa, Spathaspora passalidarum
MVTDQGDWISTFLTTYFVCLPDEIVIEILNNVTFDHLVNFFMHFPDYNIQQLTRENYSNEVHFVNRPTVTKSYGRSGYKHRFLEFHGKEAIFRFMDEFPDLVPKRIILFNEFGNFEPIRDIMETYPDRIGQVKEMKISLEKCEITIADFQCLTSFPNLTKLNFLRMDLNLIRSVLVNNSEFAQHPKLDEITFWQHGIYDWSNVWFPRTLKSLDLSWNNMIDISTLSIPGTVRRVCLNYSNLDSFKVLKTKIPDTLTELGLVGNQFETLALNQLPTELRFLDLSSNKISSVVGSNWPKELTELRISGNKLDNEALEYINDIIGWPQSITNLDISLNQFTLLENLSKLPKSLQVLDISKNSLIWNDPQLINFHFPDHLTKLNLSDCEIDSVRYFRFPSSLEKLILKSNEEDIGSW

SEQ ID NO: 248 - protein, 600 aa, Spathaspora passalidarum
MQTENDNWILSFVRIYLPRIPDEVLIQIFNLLPFGYLRNFFLYFPDDNIRNLIIHYYSQQVHFVWSKAHFFLSTINFRFGKIFNRRTYEGSNFQNKEVFRFMDEFPEIVPRRLFVASEDVQYNPVNEVLKKFHNRIYNIDEIGIYFSKCPITIEDVDYVLSLQNLTELYFCGLVLTPIFTRLIDNLNLINHPKLRKIVISHAEDNDWSRIKLPETLKSLSFGNFLNGTNTSIVSFPITIQQLSINRLDIRDLSHLKHRISGCLTDLQLNLNRLERVLIDDLPPRLRVLDLSFNSSVKSITCDDPEATWPVTLEKLILSCSGLDDNVLEMINDNIGWPSNLIKLDLSLNKFTNINNLSNLPFGLQWLNLSNNRHIRVTENFQFSSQLKFLEMSGCVIDDIQYLEFPSSLEQLNLPGNQIRNILSYRDWGKLDKLHTFGLWSNRITSLNKWFIPPNLNKLDLRGNRISTLSKGFPLFNKHYDFNIVDLNLGQCKIKKIQIDYIPTSLTKVNLSRNKLSSTFLFPSAFKRLLHLDLSNNFLTSIVFENDNCKSCLSHLNLENNPILTGQKSPEHFQEFYDYLESNLGKVTERASNYIINFKRD

SEQ ID NO: 249 - protein, 626 aa, Candida albicans
MTDFDQSTNFLLEYFPKLPDDIILLITEQLPLEYVIDWLIKIPIVQDIVIGTLYNHNDLQFLISPTKRPYMNHISALKSKLTTFKGYYQISTFIKENSSRFIPKKVLLMSGGDWSAVEELITNFKSWLVQVESIEIALESNEITPSDLKLLLEFNNLTKIHFSAVSLTKCISFLQNNSLLIDHPSLNNIIFLKHGIVNWTGIKFPRELESLDLSWESKVDITTVEVPASLNELYFNLANVSQLENIKSQISSSNLTTLMLTHDGLTEISLKALPSTLTTLDVSENPISKISDIEFGWPKNLTTLLLDTNNLTNASVAAIIEWPKNLKTLRLKSSKLTNIACLINLPDSIEILDLSYNRFETLLVNNNGDFFVFPKSLKYLQMVGCNLLPPQTIKNYMEFPESLEKLNLTHCYLSTLFYFKFPNSLVELALSGNAIQDLTSYNDVNKNWTDLVNLQDLDLYSNRIDTLQQWVPPNSLRNLNLGFNLIDELPNSWPLFNDMFNKQLQLVDLRLNVCSIEKIAEELNLPPQMKVLDLSNNSLTGPFYLSRSLKHLYVLNLAENSIDDIKIIHEDDDPCRLYLLNLSYNRICTKTRNKEAIEAFYEKLELGLNIKIRNKKFKVNSLHQLQ

SEQ ID NO: 250 - protein, 665 aa, Candida tropicalis
MCLCPDRRDNNPKKKKKKIQWMQEIPIVHESLKNMDSDDEYIDTFLVNHFPNLPDDIIVSVIKQLSLDYIIEWILHVPQLEDIVLQQFYNQNEIQFLISPTKRPHLNHVPHDKLELTTFKGYYQICTFLTENASKFVPKKLVIICGGDWSSLVCLLTDFEIWLSKIEQLELVLETHPLKSKDLENILAFKNLSKIHFSGVSLKGCSKWLRQTEMLVNHPSLSNIILLKHEIINWTDIELPRGLKSLDLSWDSTINIKTLKIPSGVEEIYFNSAKVDTISNIDMSLCGENLNTLMLTYNSLTSISLKHLPPNLKTLDLSCNLISEIKDIEYGWPDLDNLLLRDNRLVDYSISQVTQWPENLKMLALTANELETISYLENLPDTIEVLDLSNNEFKSLLVSSTGESFKFPKNLKNLQIAGCKLLLPEDGDTSMSSYLTFPHQLEELNLSECNITSLNAFKFPSSLVKLALSGNIIRDLCSYDDHISKSWTMLKHLRELDLYSNNIRNLEGWKIPENLKYLDLRVNYIETLSSDWPIFNSEFNQDLQLSHLNISYCRLEAISDNLQLPRNLRVLDLSNNSIAGTFKLLVCYKQLFSLNLSMNLIKDIEIVDDPNGVCNIFELDLGENYICHTNRNKESIQEFYSKLESGLHITIKNKKFKVNSLHRLR

SEQ ID NO: 251 - protein, 607 aa, Pichia guilliermondii
MEVQFLHQYLPQLPEQLIGEIIQYLDSDHIQFLLKVANLRQTIINEVYAREVHFVLSPTRRPHPCSSRSDLIDFTTFADADDFLLENPDINPRTVAVITHGDFSSLRSLFEKHAERFEKHIQRVEVLIESYNLTSEELDFVLSIPHLTKLQVGGITLGSCGDSLAQNLQKCISLDQLVILGHQIRDWSRVVFPLSVTVLDISWNPNTDISTMTFPPHIRDLFLNRSGIDDNLLVSMKFPKSLKTLQLTHNKLKELSVSHLPPSLETLDLSSNTISNIVGSWPPYLKTILLHGNALNDKSFDSMASWPQNLQRLRLDVNQIHFLSSLKSLPADLHYLDLSQNHFTRLEVANSAPYPYFVFPRNLKTLFLTGNDRFKYTNSVNRIEFPSTLTKLNMDGCNISSLEHFKFPENLTSLSISGNRIDNICTYNGNGVDWTQLNHLSKLELVYNRIKTLQEWVPPKNLQSLNLSENNLTELNSVKTPLFQGLDVSLTSLVLDENYISRIGDVKFPRSLQTISLENNLLTGSLNLTPFSGIREVFLKGNTITGILCDRLPGTAKITTLDLTQNEILRTSKDKEKVNEFFETLEKCFGKAVVRRKFNLNSVHTFQ

SEQ ID NO: 252 - protein, 646 aa, Debaryomyces hansenii
MDRVTSFISEYFPRLPSHVILEVLSYLPASYLTEFMMKWNNEITELILEEYFSKEMHLMLSPTYFPHRCKYPDHIKRLVDFESFGEIDEFLSEFPNVNPRRLVFITGGDFRSLEQLLLSYRERFIGKSCEIDLYIERYELDDKDLELITSFPNVRKLQFSRATMAKTVGALTNHLSKLLNLQELVFLGHKIIDWSYINFPPNLKHLDISWYEHLNVNTINVPDSVTDLFWNRSGLNSGKLYRTIFPANLKTLMLTYNNLTNIDVSKLPATLETIDLLYNSISSFTSESSDKAWPANLKSILLSHNDMTDSCLELLSELAWPVDLKNLRLDNNRFTSLVNLKYLPDQLEYLDLSFTPLKSLDISPTDSTLNSYSSFRFPEFLDTLHLSNCYHLDFSGYLATNRITFPFYMTSLNLDDCNIMDLQVFEFPKSIKKLSISGNKIEDLTSYNLTIDEGNGPKDVVNWNQLVHLVDLELYLNKIQTLDAWDVPPSLRSLDIRLNFISFISTKAPLFSSDHTQSTKNLHVLKLSDNNIKKIASDISLPPNIKVLSLDRNHLVDEFVFPESFVSSHSLEELGLSMCGLHKLTFKSLPTRNHQLKKLDLTDNYLLYEASDMRQSINEFYDELELGLGVKMSKRKFRVNSIHTFV

SEQ ID NO: 253 - protein, 579 aa, Candida tenuis
MGASACVNKFFGLCQTSVERARSVAAHIRHYDGWPEVLEYTNHTSRSSFPLSGTRTIIRYRPQARPPHFWNRCCRAIASNSPWAMSAAPTVAHDIVKSFIQRFADLPVDLILRVFELLDDSPVIKEFFLYWPATRDVVIQTYYAHELHCLVTPTSQGHVCVDGSAGSEVYDLHFSGEIDEFLTWNPHIIPHKLVLVTGTDFYSLFDLLQKYSERFRQSPQLEVLMEGSRNYVLEDLKVVLSSPNLHRLQLSRYDFEAISPMFLALLPTLENLKIIQFLGHRVNDWSAYTWPPNLLSLDCSWNTHSDVLTLSFNSSLQELYLNMSDVGTHNLQSLYTRLPSSLKVLMLTYNSIDQLYGNRLQDSIEKLDVSFNRIRYLVDDQPTDKILPENLRELNLSSNIINNASLLKLQGYRWPENLKIVNLSGNRFTNLYLLQLPDSVESLNLDGNDVQFYVDGPLIRSYKFPSQLKYLSFYNSKRLMAQIDAAVSENLVKNHVEFPDGLRHLSMIGCNLRSFSSFKFPKFLSELSVVSNLIASVDSYEFSWKEMVNLKKVDLDQATDTSNWAKPPNLNQQRFSSRY

SEQ ID NO: 254 - protein, 635 aa, Candida lusitaniae
MPESSEFRSDLFADLPWSVIYEILKYVPSDTISEGLLLVPQLRPLVLAEYYSNEIHFILSPTQRPHFCTNDPQRKELIDITSYGEIEDFLIDNPDANPTLVKVITSSDFRSMELLLNKFHDRFASFQKLDLHVDNYDLTNDDIKLIMSFPNLHKLQTGRVNVRKCSSMLSEFFPKMRNLTEIVFLGHGLSNWSDVVLPPNLTNLDVSWHPFTEVTSINLPDSLTNLYWNQVGIRNGVFESLKFPQGLTTLMVTYNNLHWINVSQLPQTLETLDLSNNNLSSFKVDGENNSWPPNLKSILLNNNHIDDHALEELSGINWPPLLENLRLDENKFTQLSYLSSLPEYLKYLDLSDTRISTFEVPHKDDEYPYFAFPQSLNTLNIQNCRTLKYGNLEAMTMVPPALRIRFPEDLETLNLSECNISTLDYFIFPKYVKKLSLTGNLISDLTSYNFHIGNKEVISWISLENLKELELFYNRISHLEAWIPPNSLSKLDLRRNQIKFLTSINTPLFNRNQNQKLTSFHMIHLEQNEIHTIDSRLTLPPNLTSLNLSRNNLSQFVFTDGFANHHNLSSLDLSWNQIEKISLSSTYAESRLSELNLTRNPSLRMNPDDFYKVLERMKLRVTKKMHNIRSVHQFR

SEQ ID NO: 255 - protein, 331 aa, Pichia stipitis
DHIVSLGLLNNQYLYTCSNEGKLVIRDLVNDDAFGSYKVYLILNPVSDVRLRMAVHDRKRITVASCGKNSELKLYEIDSNEKKECSRISVVQSGNVRTTMDLNVIRPLRRSFTTLNLGSEVISLPSSSGANNRHVSVLTPFWTSSTYAKDFLYHATSLDVISSWMISVCIIDEYVACGTQFGKLLIFSVLDDIYPIETLTLSQFPIVKLHAIDSSYVIFADSMSKVGIVKLSSLKVVSFFDNLRIGPTCSFKFVLPSNVGDRKVNGDILKFDPIYAICTTIDKRLVIYKLFDDNTHELLLEMNMGDMTIPAFSVMGDNDYETFNNIFGEPD

SEQ ID NO: 256 - protein, 528 aa, Spathaspora passalidarum
MDLLLSTQDRGSIRVVRLSKKTSDSLDISIKHEFCIGGRENYIQKILNFKFQHKPHMIIARKNGLIQLYKKTTDDDGSSYYQLCKEWKNSQLNIHDTIVSVGFLNQQYLYSCSRDGKLIIRDLINDDADEGYKVYLIQSPVADIAMKMKNNITMQVVSCGKNNDVKAYEISMDSRSSKSPSPPMTTYPLSIDLRYISLRNQPLRRSLTSLNLRDEYTPPTRGGSGSPNSDRQVSTLSPIWSSLTHYSDYVYNAHSLEKISNWIVSVAIMGTNILCGSQFGKLVLYNLASDGYPITTLTLSQFPILNLKPISDDLLMYSDSMCKVGILRVSLMKIVLQYDDLKIGPMSHFQYILPGSIGTSTTKGHRRKISGGVKFDPMYVLATTFDKRMVIYKLFDNSRSELLLDCKLGDSLIPSVSLLNKNRSDYEMIHSIFGNDDELSDSSGLDEELVITKKRRLSVIREKYDNRIGELETPKKPKQQFVNMSRHGSIEEELAEGDSELLEGISTRTSKTTHEHNECDEIHDVEFK

SEQ ID NO: 257 - protein, 418 aa, Candida albicans
MNSHTDMIVALDVLNNQYLYSCSRDGKLIIRDLINDDADKSYEVFMLMDGIGKIDLKLDKFTNTISVATCGKNSDLRLYTIDLELDNASKGNSKDPDQSDLTYVQSFRNRPLRRSFTTLSLEAPFLSAVIPPPRNTERRHSKVLTPYWQSITPLYEYVYNSDPTDQISQWMSSVCFVKGNDYIICGSQMGELIIYNPVKDISPVFKKRISQFSIQNIEQIDSDLIIFSDSMSRIIIFSISKRKIVLQFSQLDFGPFLHLKYILPHAFRRKTNDQVVTFDDIYVLSTTIDQRLVVYKLTDSGSSELLLSAKILKGMIFSATLLQSVSEYDQFRNLFGGDDEGPSAPTIIKKRKLSSNSYALMTNNNGSGHSQKSKMSFIETQDNTLANTSSSSSQTESEDDNGESFEYTNVEKHKEATK

SEQ ID NO: 258 - protein, 509 aa, Candida tropicalis
MNLLASNQDIGSIRVIKIAKKSNDMLHVDIKGELCHGSSRNNYISKILTFQYHNVSHLAILRKSGSIQLYTKNPSLSYYNLFKDWKNNLTDITGDGIIALDILDNQYLYSCSREGKLIIRDVINDDADEGYRVYMVGNNIGKVDLKLDRFKNTISVAICGKNCELKVYEIDLSLDVKDDYSEGHGSDLSYVGITRNRILQRSFTTLNLNPQRLSVSYRNHERRSSVSSLGHFWKSTTNLESYIYNVNDFECISQWMSAVQFIDGGDNIICGSQMGELILYDPLEDTLPIFTSRVSQFPIKTLKQMDEDHIIFSDSVSKIGIFQIRTKEIVLEYQGLEFGPFLDFQYILPNIPKRKISGSKLSFEEIYIMATTVDKRVMVYKLLDNGSHELLLDVKLFDGLIPSICLLNSVSEYYQFRTVFGELDHNTDPNIYKKRKVTPNLAIPISSSPCAQTRTAKKKDENGVEDKSVHIFAGMQECNDVSPISSSPDTADNKGQFIDDAHLQKMLVK

SEQ ID NO: 259 - protein, 323 aa, Pichia guilliermondii
MLGVAHGRFLYSCSTEGKLIFRDLLNDDSDTSNRIFLVQKPVSAVEVRDAEPGVVQVVCAGKGNPVKKYCVDLNRGHQDHGVRRSDICCNIIGHGGTNWWNGGGDTSTGSDWSYAVPTWSVEGVDDWIISTVSVEKTVICGTQNGTVLLFKDGASEVGHRVNLSHFPIRDLAVHGLYVVCHDSMSKVFLLDQNLAILRVYDGLKIGPVSSCKYVFDDSAFDRRRKVATSVGSDTLQMFVVTTNLENRMVIYKLEATAEMVLNMELHSGAPCFDILGHGSNFALLQEICGEAGMVPNKRRQLWQPLGMEATEVAKPRKAINHEL

SEQ ID NO: 260 - protein, 479 aa, Debaryomyces hansenii
MNVLLSTQSNGSIRAIRFRKIKDRIDFKYKNEFCIEGKGNYIQQMMLFKFQDRLYLVLARKTGLIQLYENTLAENNNRQRSFKLYKEWKHSNMNSQDSIVGIGFVNHQYLYSCSSEGKLIFRDLVNDDADESYRVYLIHKPISCIEIKMASDNKILAVCSGKNNELKIYEIETNIYEKVDDFAKTLDHFFQIPLAGNDISLNYEPVDLGRPMLQLRRRSTSLNLRSSLNERQIHTLMPMWTSSLTREEYVYHTSPMDSISNWIVSICVMPNDSGMIICGTQFGSVIVYNIDEDTAPTRIMNLSQFPITTLKLFNNNKFLLWTDSISKAGVIKLFKFKTTNLYDNLKIGPMSSCKVIVNNESTTRKLNQENDLSYFDPIYLMCSVVDKRLVIYKLYDDNTYEMIFNLQTDTLIPTMNLLAHNDIKMSYVITVPTAISEAITIAIAIMIAITITITKMITKTITIRTTITTMKEMLVKSSL

SEQ ID NO: 261 - protein, 361 aa, Candida tenuis
MSLLVSNNGSLQVAVLGPPVQYGSPICSGTGDITNVKRVQLEHQDHLVVLRVSGAVQLHKFYPAHNQYQIIKEWRNGVMHANDKIVDMGIIRQTYLYTCSGEGVFVIRDLVNDDDDHRCKECKLSGPVTSIKVSEAKENFRVAVGSKDMGVRLYQISFDKDYLVDDTIASKMYNLHQNSNVVSMNRVRYLLRRRSESASKEKLVPQWQTPAFFETYWVVSLEFWRHYVICGTQFGFIVVYDSTTVSDTPIKVIKNSGSPIINLKDVGNHLVACDMMSKINVIRLPTFEEVNSYTYNFGIIEQSKILVHRRTARDVVVVAATAAGRLVALRLRPDDSYEVVHDMAMPQPVQAFLVLRWHRSG

SEQ ID NO: 262 - protein, 343 aa, Candida lusitaniae
MFTCSNEGKFVIRDLINDDADDSVKTYLLDGPISCAEVAVMDDNMRILIAAGGRDNELKLYDVDFGCSSSCNLNRLYSVEIPNHNINSMVRFANDLAEMRPLRRSSFQYFTTFSEWKRLVPVFVMSSTEDHSLSSMPIFNWISSVAFVEHFGKRMVCAGTQYGDLIIYEAEQPYTHETETAFFHLSQFPINVLHVFCSGRYLLYSDTMSKIGVLDMDSLKVVNFYDCLKIGPSMSCRIFTSSSPMARVSCNSEVSRFSPIYVLATTLDGNIVVYKLHNNNEKELKLIVQEAGIIPDLEILDVDSYTALDSVFASPEDSKCVSNKRRRKGKMQSGISEESSEFG

SEQ ID NO: 263 - protein, 462 aa, Pichia stipitis
TSAASLAPNWVYGTTLPSQNSRGSTSSVSGLCLTERGQITVPQPEVIQNMLFPANEALKDKIVEYREKLSAILSKDISDVKSDFVNPLLVVTGPTHIKEPLQAKACAQWIGSIIGKKFVNPPSQAVPESIKHLYQKNENQVPHNVLLSLRTNLTKYNHDYSSIQSKDPVSVMTFEIEQGIPVCRALLCELAEVCPIVGETSDTITPQYLSDLFCLGIVGSTFIESQLHRELASGVSYPIGFNSLNSDLPFDKEMYGHRIVSALDSMYATGQPHQFLSVTKVGTVAVVGTTGNEDTFVILQLNLQLDFDELKAIINKVYSYSKLTRQTPRVMLDLGRVSTEQYAQKLSLLQTLLQDPDTMYKVVGVMIDSGDHYIPEKYPVDLTVDVHLDQSSDYDEDEDDHRKMMELNKYFVQRRMQKTYSVKKVPATSSTAVEKDYEYVINADKLISELEKLSKRRIEAKI

SEQ ID NO: 264 - protein, 426 aa, Spathaspora passalidarum
MSLQPRIKSPLSRTLEKSLVIETSESVNTTDTEVESPVAHSYAPEWEYHQTATKSSNTTNKGNIPIPQPEVMQKVLYPITPQLQNKIFNDRTNVNSLLSDGKKPLLVITGPSHIKDTNQIKACAQYLSLKQGNSITSSDYLPSEIKSIFHDPAELSNLHLALRTNLTMYNHAYTSPQSQSIRTFEIDKGIPKCRSLLRELSQYAPLVSEFVDTLTPQYLADFYSMGIVGPTLIESQLHRELASGSSYAVGFSAGEKSDMLDHKLTSCLDSMYATSQPHQFLSITKYGTVAVVGTTGNSDTFVILPLGDDITELVAKVNSYKNLQGKTVKLLLDIGRVSNDDYETKLITLKSVLDSEVRDQILGVMIDSGDHYVPYDYQVDDREDVESLFTLVDRASSESLSFAPNSNYEYFINANNLLLELNNLNK

SEQ ID NO: 265 - protein, 383 aa, Pichia guilliermondii
MSEISIIDLASRHAIKSLSLDDEKRKPSENQNEHVNSSAWKFDSAGESTIGSGLNLKERGYFAIPQPEIIQNYLVPLSPSLQARILKNRQDITDILQSKPGKRSGFLVVVGPSHLQGIEQAESLRDWVSSIQDFPNLLVSVRTNLSKPRLVSLTDDKQSLMPYEIEFGLPRLRSLLLSIAKDCPLVGDITNTITPQYVSDLYSMGIVGSDVVESQLHRELASGVSYPVGFSTTTEEPVLNPVMFNHRLSSALDAMFASAQPHRFLSVTKLGTVAVVGTEGNSDSFVVLPLSSMPSEDEVGSKIKAIYDYPKIGTDSPRVMLDVGKLGDSNYEEVLSLVKRTINGPAGHKVMGVTIDSGDSYGQGNKQVLYAEKMLHEINSILS

SEQ ID NO: 266 - protein, 388 aa, Debaryomyces hansenii
  misc_feature (5)..(38): Xaa can be any naturally occurring amino acid
SYVSXXXXXXXXXXXXXXXXXXXXXXXXXXXXXXXXXXLKNILLSLRTNLTKYNHGYNDPSFLRGFNSIMTYEIEQGIPICRALLCELAEICPIVGETSDTITPQYFSDLFCLGIVSSKLRESQLHRELVSGVSYAVGFHTLDDTLCFDKEFYTHNITSALEAMYASSNPHQFLSVTKIGTVAVVGTIGNDETFIILLINLELDYYEIEHIIDQVYDYSKLNIKRPKIMLDVGKISNEEYELKLDLLRQLLVLNTDLKYKIIGVIIDSGNNYISHRYTIDLNKPFGVNEDFENQDYITDDDIERNKNDNDKSENSMNHQMLIGLNNYFVKDRIYGKMSPSRQSQQRPSSELDFDSSLIHLDKYYEYFVNADKFIQELDDMSSLRINSQ

SEQ ID NO: 267 - protein, 589 aa, Debaryomyces hansenii
MESSIDMNEELKKLKSHKDATFQLDAKEAVSSACEPENKSTCETTVETNDIESDIEGEPKYGTVDNSQQLMDQLNKLKIMLEQDSAKVSSSNTSSGGSSSVSLAPKWIYGTTLPPLNASRNNYSSASGLCLSERGQVAVAQPELIQNFLFPTTTLLQQKVVKYRESIGNILSADIISKKSAFKNPLLVITGPSFITDANQAKACAQWVGSMNGKKFHDLPNGILPDSILGLYHRSNRLELKNILLSLRTNLTKYNHGYNDPSFLRGFNSIMTYEIEQGIPICRALLCELAEICPIVGETSDTITPQYFSDLFCLGIVSSKLRESQLHRELVSGVSYAVGFHTLDDTLCFDKESYTHNITSALEAMYASSNPHQFLSVTKIGTVAVVGTIGNDETSIILLINLELDYYEIEHIIDQVYDYSKSNIKRPKIMLDVGKISNEEYESKLDLLRQLLVLNTDLKYKIIGVIIDSGNNYISHRYTIDLNKPFGVNEDFENQDYITDDDIERNKNDNDKSENSMNHQMLIGLNNYFVKNRIYGKMSPSRQSQQRPSSELDFDSSLIHLDKYYEYFVNADKFIQELDDMSSLRINSQ

SEQ ID NO: 268 - protein, 488 aa, Candida tenuis
MNSLKSAYDSLHKEEGVEEKTLEKINSDTNLKYRDVAGAKPTKAILAPNWVYGTTSPRRPTSSVGSGLLLASNGHIAVPSPEVIQNYLYPISPTLQQKILKYRTNLSQLMTSSLDSSTADRPLLVLVGPSAIKNSNQIKACSQWIGTLLGKRFQYTPTQCASEVQQIFNSTYKPANLMLSMRANLSQYTTPYAEFDQIQSFAGSVSTFEVSHGMPYCRALLDDLCEICPIVGDISDTLTPQYLSDLFCYGLVSSTLIESQLHRELVSGVSFPVGFSTSDSNLSFDKLMYKHKLQSGLDAMFASTQPHQFLSVTKLGTATVVGTTGNDETFILVEVNTDLTLEDVQECIDKVYSDKPLRLHYPRIMLDVGKLSADDYDHKLDVVATLLSSSSYYKSTILGVVVDSGDDYVPTSYKSDLTQTGFAAASDDNANHDEGFEEMKRYFTRNSLGSTDTVSYDESMQESSFEYFINANKFISQLDKLKSQNSYS

SEQ ID NO: 269 - protein, 427 aa, Pichia stipitis
NHQIHQNHQNQQQQQYLQIPLGKSEFELTEYDLKSRDSKYRRWTPKMDQFLIKLLSDVVHSYPKGAEAEMTKKAWAYVTGQLRAANPETVYSTYTKYSCQQHLLNVNHHRYKIWYYLMLHQKNAPATSYAYRWNPELGRFQVIDNANSTLILDERQVKSLLYSDSLLLPHLQSFNKGNLIVNDFFLSDNLRYMSVYHNEVLPLLIRLDPKYAEGLGDLYADIPKFDYQEASLEYFKPLVPARAHKMAPVQQSVVKKRTHSDIPSDISLPFSKSLGSLTDDTDPDVSGQQQLVPDEDSVDPALKRSRNSLQDTTSNTMDFENALATAAIAAINSPPVTNGRDSLPFYIKDRKWFNRLLNLHESGLIGVQEVLTVCEGVRDGKIPLFMLNVLDQSYYPTRNNTGLSEELPDDETAKRIREFMLPMVYNS

SEQ ID NO: 270 - protein, 558 aa, Spathaspora passalidarum
MSDSIRKSMVQVEAQHAAEALRIATQTASQQAQQAQQQQQHLHHHHHRQQQQQDHQKLLLQQQLQQQQQQQQQQQQQQQQQQQQQQQLLQQQQQQQSQRSHYTQQIQQRAEQQQHDHENRVTQELEQASHQVQQYNDLSEYDLKSRDSKYRRWTPKMDQFLIKLLSDVVHSYPKGADAIMTKKAWAYVTGQLRLANPETVYSTYTKYSCQQHLINVTHHRYKIWFVLMLHQKNNPSNTGYSYRWNPDLGRFQIIDNTTGSLILDERQVKSLLYSESLSLPSLSAFNKGNLIVNDFFLSDHLKYMSVYHNEVLPLLIRLDDKYAEGLGDIYSEIPKFDYQEANHEYFKPLVQPKHRVTMSTPGSASSTSPSATTTPSKSKKRPHHHSEDVTLPFAKFGGSPEADVLHQTHHLPQQPQPHLHPQPHQQQHALDESVDPALKRSRIQDQANSIDFENALATAAIAAINSEPVTNGRDPTPFYIKDRKWFNKLISLHDSGLLGVDEVLSVCEGVRDNKIPMFMLNVLDNSYYPSRTGMSEDIPDEETVKRIREFMLPMVYNS

SEQ ID NO: 271 - protein, 610 aa, Candida albicans
MSTNTDPKTNKPRKFVVVVPESFLETKESSSQSKAQRKEQQKLLQKQKLIQIREKRKRKSQKQKKASSRSQAPSQEHQLHQQQQQVQTGNQEIANDQHHQQQQHQQQQQQQHFHNQGTGHNYALGFIQPTFDSQYPNKSPNVLASTDSSFPRLSSYDLKSKDSKYKRWTPRMDQLLIKLLSDVVHSYPRGAEPEMNKKAWLYVCKQLRYANPETVYSTYSKYSVSQHLSNVIQHRYKIWFQLMVHSKTITTGYSYKWNSTLGRFEIIDLITQSLILDSRQVKSILYGNTLSLPDLSQYNKSAIITNDFFLSDNLGYMSVYHNEILPVLAKLDSKYIEDIGIDGDIYTKVPKFDYPEGHNEYFKPLVPAKKPSNKRKKPEVFRQYLQTNGLHQYIEDDDQVGSSSTGMLQQFRRTSEEPIPLVFKEPIVDPSLRNTRIDANRSRLSSQRSQPPQPPQEPQLHTFRPMQQSQQQLHQSFSAHPQQNQNHHQEVQMSIEIENALASAAKAASDSPSARANKDSTPYYLKDAKWFNKLLQLYDSGHIRADEVLCVCEGVRDNKIPLFMLNVLDHGYYPTRTPNNQPARAHSEEISDEETANRIRDFMLPMVYNS

SEQ ID NO: 272 - protein, 599 aa, Candida tropicalis
MSSNRLQSNDRKFVMVVPEQFIDSKNDIPSQHQYSQQHHNIHHEQQHQRQQQQQLKIHQEMVHLQQQQQQQLDANNVYLQRFNHHEPLDSNPIIPIPTTTATTSAMTNTTNSNYDTGLTQFDLKSKDSKYKRWTPRMDQYLIKLLSDVAHSYPRGVAAEMNKKAWLYVCKQLRLANPETVYSTYSKYSIQQHLINVIHHRYKIWYKLMVHSKSIASGYSYKWNPELGKFQIIDLNTKTFILDVRQVKSILYSDSLNLPNLSNLNKGNLITNDFFLSDNLRYISVYHNEILPLAIKLDEKFLEGFEDGNIYRQVPKFNNYPESKNAYLKPLSQVKKNPGISKKRKESTRKRNQFNSIDNDNDNNDNHQHHDHHDVDDVGNQNDEQQDRHVVFNQDVLPLEESVDPDLKRARLEYQNPSTSTIRNQLPIQQQQQQQQSSLPPQRQPPIPQQQQTSNQLQQLQQQQQQQQQQTHVQTPQRPAMQMNIDIESALTSATIAAMNAPPIRSSKDTSPFYIKDAKWFNKLIELFDNGHIRADEVLSICEGVRDNKIPLFMLNVLDHSYYPTRTNDGTTTTAHHRDIPDDETTKRIREFMLPMVYNS

SEQ ID NO: 273 - protein, 334 aa, Pichia guilliermondii
MSPGPKFPQLSVFDLKSKDAKYKRWSPKMDHYLVKLLADAIGRVKDKNDKKVWAHVTNGLRAVNPQTVYSTYTKYSCQQHLFHVIHHRYKIWYALMVHQDKANAFSYTWNSELGKMELINETTQTKINDENALKDILYRQALPLPSLSQFSKGLVIVNEMFLTDNLRYMSLYHSVVVPYLIEVDSRYADIEDYNAILLKNFQGVHFESPGLEDEIGFMDTISDKSGGNLTLESTMVSAAIAAVNSPSVIIANEDYPVYVKDRKWFSRLIALHEKKYITSDEVLAVSIGVRDGKVPLFMLNILDASYGEASQSKDEPDDIVASRVRTYMLPLVYQ

SEQ ID NO: 274 - protein, 458 aa, Debaryomyces hansenii
MSTSDLKSTILQESTRAQNVHHAAEALRIATQSTHHQVHNQQHVQQIDKEQGNNIHEFSEYDLKSRDSKYKRWSPKMDQFLIKLLSDVVHSYPKGAEAEMTKKAWAYVTGQLRAANPETVYSTYTKYSCQQHLFNVNHHRFKIWYILMLHLKNNQTTDGYSYRWNPDGGRFQIIDNTNGGIIQDERQVKSLLYSDSMSLPSLSSFNKGNLIVTDFFLTDHLGYMSTYHNEVLPLLIRLDNRYADGLGDLYHEIPKFEYRDSNKEYFKPLVQAKSIKLGTNDASKTKKRTHSESNQSHNSQGDVPLFTNSLSSMQHDPEVGDEDTVDPALKRSRNINTPETNSNATTTEFENALATAAIAAINTPSVTNGRDIQPIYIKDRKWFNRLVSLNESGLITPNEVLVVCEGVRDGKIPLFMLNILDQSYYPTRSAEDITPDETPDEEAAKKIREFMLPMTFNS

SEQ ID NO: 275 - protein, 398 aa, Candida tenuis
MHGKSIKFTPYDLKSKAAKYKRWSPKMDQFLIKLLSDVVHSYAKEERPQLNKKAWAYICNQLRIANPETVYATYTKYSCQQHLIHVIHNRYKLWYTLMLHSKNADPNVGYSFKWNPNLGSFQIIVTADNTVITDESIIKSIIYGESLPLPSVEKFPKGNVVVNDFFLSDNFSYMSDYHNEVLPMLIDSDPSYMEGFGSIYNDIPKFKYEGFNTDYQKPLQMIRAKRTPDKYNGSSSIPASDNSSTSHNHTHPNSYQQLVSQSHNQHHGHGHTASNQVPDLSSHDVSMEKRSLHGDFEGDLSSTGIAEFHSPQGVPGANDPQTYQKDRPWFTKLMALHESNLITINDFFTVLEGVRDSRFPLPLLNILDPGAGESKLSDREIAKRTKMYIIPRCESFKH

SEQ ID NO: 276 - protein, 73 aa, Pichia stipitis
MVIASNGHFLTQIPQPIHKFSEMKAILDAGVTSIHNFPVLTTGHDLRHSCLHFLGLHLSVLTMAILVDLSLIF

SEQ ID NO: 277 - protein, 98 aa, Spathaspora passalidarum
IVMASNGHFLTQIPQPIHKVSEMKAILDAGVTSIHNFPVLTTGQLFLHSCLHFFGLHSSVETIAILSFLESVSPFVLFFARALILICLLSSDYCLSVG

SEQ ID NO: 278 - protein, 75 aa, Candida tenuis
MLMASKGHFFTQIPHPIHKFSEMKAILEVGVTSIHNFPVFTTGHPFRHSCLHFFGLHLSEEIIAISVFLSLMFSV

SEQ ID NO: 279 - protein, 532 aa, Pichia stipitis
MKKSDTKQLLSPLDEPNNIPAAGDFDFSHAVSSFKPGNYEIDDLPKRIPIFNPKTGKIQRFVRNRREIPARRAVSMPVPSTSSSGSFPSAFSKELPSPPISEADNESGSSSANSLLSEYRVISMYTHPTSSIDKYHESLPPLHPLPPLPSSQDSEDVSSESSLIYSDHKTTYSMKISSPFKAKNVITDDDESLFSELSHSSRTDTSSDLSEHSDSPSLIARSIMYVVHEYSSATNSEVSLATTGQNIPVDDYYWMDDLPDSLFSNNAVEEEPREKMITPSNTKKLLEPIKIAATPMPHKNKPLPLPLPMQKSRKGMDRRVQNNSKECSSSFISLKSGESSFTEAKHGLAAYVRQNPFNYSLDGPKQYKLSRFPSTAVPKKKRVQSAYSTSTQKSTEMTPSSKPRTVSMYSVPYPTSKNPIPPVVSSKQVVTPKGVSGTSFQKPRKISEGKTRNSALPSLPVYPTSREGEKEEMIKNHVLSFLLKMKQMKKEQGGGAVKRQGRAPSSSSKNLPQVPEIERDNRFRRNAQGMRW

SEQ ID NO: 280 - protein, 430 aa, Spathaspora passalidarum
MTAQTFKQRLRTTDKPPMIPALEKTDFSHAVDTFRPVSMDLSDIPDIIRQFNRREENEAKKPKKKRVVSTPIGLESYREPIQFPQGYNVASIPMPKRRVVSQPLLSNVKELPDVPNVEPLEEEEEEDLEQMHSNSSKSSSTSVHDSRHEIASQESNIRPPPPSYNNSYNSQYLHSKHSSTYSSNSIEYMLNYPSQKHQEPPQSPDSSYNSVNSLYYTPQEYHASYALDSIEYPKLETSQYRTKQQSDSKNTSYGTYKLHFRPTEYRSSFSDDNMDYLSHEFSNLEIAKSNEDSLFSNPLVDPGSSQEDLYLTISPEETKKQLSPVPEILPKVRKSNSKHKPKPPVFHNSLYSEKHTIIEQVKQRPFSYCLDSKHNYEDSRYPIAPPIKKVQDINKPRATKRNSTLTINTTNTNVNEQRRSCHLLEKRVKK

SEQ ID NO: 281 - protein, 570 aa, Candida albicans
MKKSNSKQLLTTLDLPPIIPASITTLDFDHAVNSYQPGNYNPEDLPDKIPIINESTGSFRRFIRRAKSTRIKKNNDKRRIVSAPPGTYTGKELPDIPSSMPTTPITIIAPKDRTNRKPLYTNPPRTISLINENIPYPVLTTPNYNPHQIKLVVDEPHLKLEPKLTNDSETDSIGTDSILSTKSIDIPVAIHDDAKVTVTHNCNSSSSDNDSLVDSLFSKEEEQEGDQIDPVTSHEEHEIESSTLVLPKMRKKSSPSPSSLSDKIGHFQTKSSSHQIKTKSLGYCLDTPNVYKESRFPSVPSHIKVPKQVNESGGGGGATHKNIENSKTDKRRSLSDFTHMKHALTKLDHHDNNSQEVKHRSLISFSQLKLGSKEDINKKTDKESDKRRSWYVDFIPHGNSNRDDAKQQKHRSVSNIVVSKTKQLEPTTFSTTTTTQDKYNRKKRLSYSDFIRPQVRSVSTPNDTRAKKILPPLPPKHDINNNNNYTQSENVVEPRYYINTYIKPRRNKETNTNINIIPKTSTCDNKNQLYSITNKPTMGKSLPPLPPPSPPKIHGEYYRTNRFGERSHYV

SEQ ID NO: 282 - protein, 404 aa, Candida tropicalis
MKNSNNKQRLSSLDLPPPIPAALDTLNLDYVADSYQPGQYELSDLPDKIPIINERTGSFRRFIKRKTPRDRRRIVSAPPGTILEKALPKPPATSRNSFYATPALPLPKASSTPSLPKPRTLRPKPRPFSMAPRSISLINENIPPILTTPGHNPRNSMVIGEDSDLKLQPQQSNSSSDYNSIISDYIMPMDYYSPKDQQDANLDSNSFVDSLFSEDKPANNNRQSISSSEEMGNPIIENPLNLPKTRDKQKVRFTDKPSSYKIKPDSLRYYLDLPQDYNESRFPSVPKNSHFDELESRYQNKVEEKHRSFSDFTHFKVHMIDNPSTTADKQEKRRSFSDFTNFKVRSVSVPTSQPSSNRSTTPTTKTNIKSFFNRFKSKDVSKEKSLPPLPCEKSQPRQKKYYFE

SEQ ID NO: 283 - protein, 410 aa, Pichia guilliermondii
MKIDNKQRLSSYDTPAQVPANILNIDLSHAVSSYHGGQLSMSDLPPELPVFKNGRLARFVTHTPKPRAVSMPANLKQLPSVPKKPTLMSPTSRPKPSGTPARVFSELPPVPSKSPAPVPSQLPHLPSQLPQVPSQLPQSSSQLPSQSPSFPTFNEPHMSLPPKQKAASLSSHDSDSQFSLSSGTNASSMSGTSSRILQFVDTYVSESSDSIISKYERIVDPDVYTLSGVTTDSLFSDDELQGRQLSTRSEKSLPELPLAPLPQLKLRKRQPRKCTDHQSLSSAQSKASRVSSNSLQESKAEIKATVLRKPFEYCLDSSKVYESTRFPSASLLAPKTMATGLQRPPIQPRCVTAAPDFQSAKFAAKPKTEDTKRTMLLVSSSRYQEPWKRVLSSKQLPATPDERCNRFAYI

SEQ ID NO: 284 - protein, 483 aa, Candida tenuis
MSYKQRLSSCDAPSPIPASLDSLDLSHVGYSHKADFKYQLEDIPGLPIFKKNGKFKRFVTRDPNQKRVLSMPLLSSESLDKDLPIIPSRCVTSFNRFSMPQLDEQLSEPLVEFQSTPPRPQTMYIVPPHRPFSNQPLRKYIVDNDDDIDSLFSTNKSGTSNITTYTTDDIETAESILDLVQAYGNDSSSDDLEEAGDDSSSIYSQDSKISGLVTNYIEEPDVGLPFDEDVYSIIDSLFDDVPVVPVAAKKLPSIPQQSPSPENPPIISLDIKKSRNKVSFDDNNIKSAWSKADSSSGSTGVFPSPFRRPVSMNLDLMRPKHQVYQRPVSMMSTSNVSVSTCVSTNTVQIAKSDIKNIVRQRPYSYCLDSPSTYNYSRYAITPQPKITSNPYSSTLAPVVGSVQSSDANKVIPPQTPITPTTGQFTPQGSPKLLPPTPPPKQSQSRAVSLPVTPPGSPASKEERMKSTIALFLKQERGRKVSGL

What is claimed is:

1. A recombinant nucleic acid vector comprising a heterologous promoter operably linked to a nucleic acid encoding a polypeptide having aldo/keto reductase activity and comprising an amino acid sequence that is at least 95% identical to the amino acid sequence of the aldo/keto reductase polypeptide encoded by the nucleotide sequence of SEQ ID NO:1.

2. A recombinant yeast transformed with the recombinant nucleic acid vector of claim 1.

3. The recombinant yeast of claim 2, wherein the recombinant yeast is of the genus *Saccharomyces*.

4. The recombinant yeast of claim 2, wherein the recombinant yeast is of the species *Saccharomyces cerevisiae*.

5. The recombinant yeast of claim 2, further comprising XYL1, XYL2 and XYL3 genes.

6. The recombinant yeast of claim 2, wherein the recombinant nucleic acid vector is an extrachromosomal vector stably maintained in the recombinant yeast.

7. The recombinant yeast of claim 2, wherein the recombinant nucleic acid vector is integrated into the chromosome of the recombinant yeast.

8. The recombinant yeast of claim 5, wherein the recombinant yeast is of the species *Saccharomyces cerevisiae* and the XYL1, XYL2 and XYL3 genes are from *Pichia stipitis*.

9. A method for producing ethanol by fermentation of xylose a yeast, comprising: (a) culturing the recombinant yeast of claim 2 under ethanol-producing conditions comprising xylose; and (b) isolating ethanol produced by said recombinant yeast.

10. The method of claim 9, wherein the recombinant yeast is *Saccharomyces cerevisiae*.

11. The method of claim 9, wherein the recombinant yeast comprises XYL1, XYL2, and XYL3 genes.

12. The method of claim 9, wherein the nucleic acid encoding the polypeptide having aldo/keto reductase activity comprises the nucleotide sequence set forth in SEQ ID NO:1.

* * * * *